US010168327B2

(12) United States Patent
Lesage et al.

(10) Patent No.: US 10,168,327 B2
(45) Date of Patent: Jan. 1, 2019

(54) PROTEIN CHIPS, PREPARATION AND USE THEREOF

(71) Applicants: CENTRE NATIONAL DE LA RECHERCHE SCIENTIFIQUE, Paris (FR); UNIVERSITE RENE DESCARTES PARIS 5, Paris (FR); HOSPICES CIVILS DE LYON, Lyons (FR); UNIVERSITE CLAUDE BERNARD LYON 1, Villeurbanne (FR)

(72) Inventors: Florian Lesage, Valbonne (FR); Franck Chatelain, Antibes (FR); Michel Mazzuca, Paris (FR); Veronique Rogemond, Lyons (FR); Marie-Madeleine Larroque, Antibes (FR); Jerome Honnorat, Bron (FR)

(73) Assignees: CENTRE NATIONAL DE LA RECHERCHE SCIENTIFIQUE, Paris (FR); UNIVERSITE RENE DESCARTES PARIS 5, Paris (FR); HOSPICES CIVILS DE LYON, Lyons (FR); UNIVERSITE CLAUDE BERNARD LYON 1, Villeurbanne (FR)

( * ) Notice: Subject to any disclaimer, the term of this patent is extended or adjusted under 35 U.S.C. 154(b) by 611 days.

(21) Appl. No.: 14/375,623

(22) PCT Filed: Feb. 1, 2013

(86) PCT No.: PCT/EP2013/052009
§ 371 (c)(1),
(2) Date: Jul. 30, 2014

(87) PCT Pub. No.: WO2013/113864
PCT Pub. Date: Aug. 8, 2013

(65) Prior Publication Data
US 2015/0018251 A1    Jan. 15, 2015

(30) Foreign Application Priority Data
Feb. 1, 2012   (FR) .................................... 12 50956

(51) Int. Cl.
*G01N 33/564*   (2006.01)
*G01N 33/543*   (2006.01)
*G01N 33/68*    (2006.01)

(52) U.S. Cl.
CPC ......... *G01N 33/564* (2013.01); *G01N 33/543* (2013.01); *G01N 33/54366* (2013.01); *G01N 33/6845* (2013.01); *G01N 33/6854* (2013.01); *G01N 33/6872* (2013.01); *G01N 33/6896* (2013.01); *G01N 2333/70571* (2013.01); *G01N 2800/28* (2013.01); *G01N 2800/2828* (2013.01)

(58) Field of Classification Search
None
See application file for complete search history.

(56) References Cited

U.S. PATENT DOCUMENTS

2009/0155261 A1\* 6/2009 Dalmau et al. ...... G01N 33/564
424/133.1

FOREIGN PATENT DOCUMENTS

| WO | WO 2004/108762 | 12/2004 |
| WO | WO 2006/033972 | 3/2006 |
| WO | WO 2011/142900 | 11/2011 |

OTHER PUBLICATIONS

Roche et al., J Immunol Methods, 338, 2008, p. 75-78.\*
Invitrogen ProtoArray® 4.0 Excel Worksheet, 2008.\*
Irani, S. et al. "Autoantibody-mediated disorders of the central nervous system" *Autoimmunity*, Feb. 2008, pp. 55-65, vol. 41, No. 1.
Pruss, H. et al. "Anti-NMDA-Receptor Encephalitis. An interdisciplinary clinical picture" *Der Naervenarzt*, Jan. 31, 2010, pp. 396-408, vol. 81, No. 4.
Robinson, W. H. et al. "Protein and Peptide Array Analysis of Autoimmune Disease" *Biotechniques*, Dec. 1, 2002, pp. S66-S69. vol. 33.
Written Opinion in International Application No. PCT/EP2013/052009, dated Apr. 5, 2013, pp. 1-8.
"Absolute identification of novel autoimmune biomarkers; ProtoArray(R) Human Protein Microarrays" *Protein Microarrays*, 2009, pp. 1-6, XP55254290A.
"Access the human proteome on a microarray scale; ProtoArray(R) Human Protein Microarray v5.0" *Protein Analysis*, 2009, pp. 1-4, XP55456462A.
Chatelain, F. C. etal. "An Ion Channel Chip for Diagnosis and Prognosis of Autoimmune Neurological Disorders" *Recent Patents on CNS Drug Discovery*, 2013, pp. 1-9, vol. 8, No. 3.

\* cited by examiner

*Primary Examiner* — Kaijiang Zhang
(74) *Attorney, Agent, or Firm* — Saliwanchik, Lloyd & Eisenschenk

(57) ABSTRACT

The present invention relates to the field of medicine, in particular of research and diagnosis. It relates more particularly to a novel tool for detecting antibodies in a biological sample originating from a mammal. This tool, which is in the form of a protein chip, can be used in screening for new targets of interest involved in the occurrence of an autoimmune disease, in particular of a disease affecting the nervous system of a mammal, and also in the diagnosis or the monitoring of the progression of such an autoimmune disease. The invention also relates to a method for producing such a tool and also to kits comprising it and enabling its use.

Figure 1:
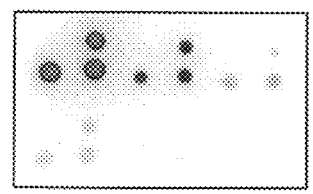
Figure 1:
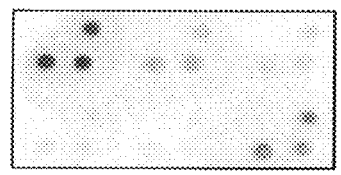
Figure 1:
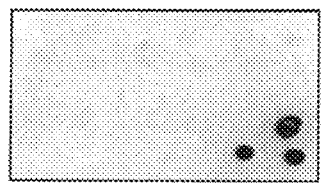
Figure 1:
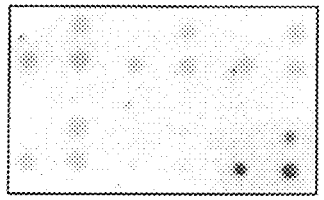

10 Claims, 3 Drawing Sheets
Specification includes a Sequence Listing.

| NR1 | NR1 1/4 | NR1 1/16 | NR1 | NR1 1/4 | NR1 1/16 |
|---|---|---|---|---|---|
| NR1 1/64 | Empty Vector | IgG 1/200 | NR1 1/64 | Empty Vector | IgG 1/200 |
| NR1 | NR1 1/4 | NR1 1/16 | NR1 | NR1 1/4 | NR1 1/16 |
| NR1 1/64 | Empty Vector | IgG 1/200 | NR1 1/64 | Empty Vector | IgG 1/200 |

A

V5
Expression control

Positive patient control

Negative patient example

Positive patient example

B

Plate No. 1

A

Plate No. 2

B

Control V5

C

Example of non-specific response

D

Example of negative response

E

Example of positive patient

H7 = new ion channel never yet described in an autoimmune disease

F

PROTEIN CHIPS, PREPARATION AND USE THEREOF

CROSS-REFERENCE TO RELATED APPLICATION

This application is the U.S. national stage application of International Patent Application No. PCT/EP2013/052009, filed Feb. 1, 2013.

The Sequence Listing for this application is labeled "Seq-List.txt" which was created on Jul. 25, 2014 and is 2,557 KB. The entire contents of the sequence listing is incorporated herein by reference in its entirety.

The present invention relates to the field of medicine, in particular of research and diagnosis. It relates more particularly to a novel tool for detecting autoantibodies in a biological sample originating from a mammal. This tool, which is in the form of a protein chip, can typically be used in screening for new targets of interest involved in the occurrence of an autoimmune disease, in particular of a disease affecting the nervous system of a mammal, and in the diagnosis or the monitoring of the progression of such an autoimmune disease. The invention also relates to a method for producing such a tool and also to kits comprising it and enabling its use.

PRIOR ART

The prior art provides several types of tests for detecting the presence of a target molecule within a sample. Among these are radioimmunoassays (RIAs); immunofluorescence assays (IFAs); luminescence immunoassays (LIAs); EIA assays (enzyme immunoassays), in particular ELISA assays (enzyme-linked immunosorbent assays), i.e., enzymatic immunoassays on a solid support.

MA (radioimmunoassay) makes it possible to measure antigen concentrations in a sample using antibodies labelled with a radioelement. The assay of the radioelement measures a number of disintegrations per second. This technique is the reverse technique of the RBA ("radiobinding assay") which makes it possible to quantify an antibody by means of the corresponding antigens. These techniques are simple to carry out and inexpensive, but require the use of radioactive substances, often iodine isotopes bonded to tyrosine residues. Radioimmunoprecipitation assays (RIPAs) enable the precipitation of an antigen of interest present in a sample using a labelled specific antibody. This method can be used to isolate and concentrate a particular protein within a sample comprising thousands of other proteins. The technique requires the antibody to be coupled to a solid substrate.

Immunofluorescence assays (IFAs) use antibodies (or immunoglobulins) and also fluorochromes (chemical substances capable of emitting fluorescent light after excitation). The fluorochromes most commonly used are phycoerythrin (PE), fluorescein isothiocyanate (FITC), the Alexa Fluor range, and green fluorescent protein (GFP). These assays have the advantage of giving results very rapidly, or even immediately, dispensing with the long exposure times required for the technique with radioactivity. Fluorescence has the drawback of not being permanent, the intensity of the fluorescence decreasing over time until it becomes undetectable. In the context of luminescence immunoassays (LIAs), the enzymatic activity is measured by luminometry.

The ELISA (enzyme-linked immunosorbent assay) falls within the more general context of EIAs (enzyme immunoassays) in which the assaying of a reaction between antigen and antibody is coupled to a reaction catalyzed by an enzyme which releases a coloured component that is monitored by spectroscopy. The ELISA is a biochemical technique, mainly used in immunology in order to detect the presence of an antibody or an antigen in a sample (e.g., Gotti et al. Muscle & Nerve, 20: 800-808, 1997; Franciotta et al., Clin Chem. 45: 400-5, 1999; Hewer et al., Clin Chim Acta. 364:159-66, 2006). The technique uses one or two antibodies. One of them is specific to the antigen, while the other reacts with the immune (antigen-antibody) complexes and is coupled to an enzyme. This secondary antibody, which is responsible for the name of the technique, can also cause the emission of a signal by a chromogenic or fluorogenic substrate.

The assays available and described above are not, however, sensitive enough to detect very low concentrations of target molecules, typically of antibodies, in particular of autoantibodies and even more particularly of autoantibodies directed against membrane proteins and/or membrane protein complexes.

Moreover, they must generally be used on small amounts of serum. A dilution thus often proves to be necessary in order to avoid an excessive background noise. ELISA assays, for example, can require an at least 50-fold dilution of the serum. Radioimmunoprecipitation assays (RIPAs) prefer the use of only a few microliters (approximately 5 microliters) of test serum in order to avoid the use of large volumes of antiserum generating unacceptable background noises (i.e., inappropriate values of the radioactivity of the negative controls) owing to excessively large pellets. Even though some specific ELISA assays may use larger serum volumes (e.g., 50 to 100 microliters), their use is, however, limited and their sensitivity is not increased. For example, a commercial ELISA kit from RSR Ltd for detecting anti-nicotinic acetylcholine receptor (AChR) antibodies associated with myasthenia gravis allows the use of a combination of three anti-AChR monoclonal antibodies in a sandwich-type assay using 100 microliters of serum. However, this technique does not increase the sensitivity of the assay compared with the standard RIA assay. In addition, according to Irani et al. (Autoimmunity, February 2008; 41(1): 55-65), the ELISA technique, just like the "Western blotting" and "phage display" techniques, allows the identification of autoantibodies directed against non-conformational epitopes, but not that of autoantibodies directed against functional epitopes. The "Western blotting" technique, like immunohistochemistry, in particular involves the denaturation of the proteins of interest (H. Prüss et al: "Anti-NMDA-receptor encephalitis", Der Nervenartz, vol. 81, no. 4, 31 Jan. 2010, pp. 396-408).

A certain number of recent studies (Vincent et al., Autoimmune channelopathies and related neurological disorders. Neuron 2006 52:123-138, and Vernino et al., Autoimmune encephalopathies. Neurologist 2007 13(3):140-7) show the presence and the involvement of autoantibodies in pathological conditions affecting the nervous system. The notion that neurons can be the target of an autoimmune attack, in particular in the central nervous system, is quite recent. Graus et al. (J. Antibodies and neuronal autoimmune disorders of the CNS. J. Neurol. 2010 257(4):509-17) suggest the detection of autoantibodies for diagnosing paraneoplastic neurological syndromes. Irani et al. (Autoantibody-mediated disorders of the central nervous system, Autoimmunity 2008 41(1):55-65) describe the existence of autoantibodies directed against ion channels and surface receptors having pathogenic effects in myasthenia gravis and acquired neuromyotonia. The pathogenicity of these antibodies is supported by the fact that encephalitis and paraneoplastic neurological syndromes (PNSs) respond positively to immunomodulatory treatments and to plasmapheresis. Furthermore, this positive therapeutic response correlates with a decrease in the titre of these autoantibodies assayed in the cerebrospinal fluid.

From a practical point of view, the regular description of new autoantibodies and the spectrum of associated syndromes are such that neurologists still have trouble estimating which antibodies or which set of antibodies is of use for diagnosing a given syndrome. The importance and the potential of such markers for diagnosis and treatment are, however, in no doubt, and require the development of systematic methods for detecting and characterizing these antibodies in order to meet the need for very substantially improving correlations between clinical syndrome, immunological signature and therapeutic response. Among the pathological conditions affecting the nervous system (neurological disorders or disease) which do not, at the current time, benefit from an adequate method of diagnosis are, in particular, encephalopathies, in particular those associated with neuronal excitability disorders.

There is, in fact, at the current time no tool which is sufficiently sensitive and specific to be able to effectively detect the autoantibodies, often present in very small amounts, directed against membrane proteins or membrane protein complexes, in particular proteins or complexes comprising functional epitopes, described as being involved, or suspected of being involved, in the occurrence of these encephalopathies in humans. Thus, for example, WO 2011/142900, which describes a method for the diagnosis of a neurodegenerative disease comprising the detection of autoantibodies and also a chip fabricated using proteins, specifies, however, that these proteins are produced in insect cells, and not, contrary to the invention, in mammalian cells, before being purified. Such a production method inevitably has an impact on the post-translational modifications of the proteins thus produced and, therefore, the recognition of epitopes by possible autoantibodies. It is also impossible, using such a chip, to enable the coexpression of partner subunits (protein complex) at the surface of said chip. The other types of tests for identifying autoantibodies that are carried out at the current time generally require, for their part, the sacrifice of animals, typically rodents (rats, mice), since they are all carried out on cells, in particular on transfected cells, or on tissue sections (typically placed on glass slides).

SUMMARY OF THE INVENTION

The inventors presently describe, for the first time, a protein chip for detecting antibodies (in particular identifying new antibodies), preferably autoantibodies, even more preferably autoantibodies directed against membrane proteins and/or membrane protein complexes, in a biological sample. This chip comprises at least one solubilized protein of interest and is in the form of a support for detecting the complexes formed between antibodies, preferably autoantibodies, and epitopes specific for said protein and/or for said protein complex, it being possible for said specific epitopes to be sequential or conformational epitopes. In one preferred embodiment of the invention, said at least one solubilized protein of interest is a solubilized membrane protein of interest and the protein chip is a membrane protein chip. In one even more preferred embodiment, the solubilized membrane protein of interest is expressed in the cells of the nervous system of an animal, preferably of a human being, and is involved or suspected of being involved in the occurrence of an encephalopathy associated with neuronal excitation disorders.

A considerable advantage of the protein chip according to the invention is that, owing to the preservation by the protein of its native three-dimensional structure, it makes it possible to detect both sensitively and specifically any antibody present in a biological sample capable of binding to any one of the epitopes (sequential as well as conformational) formed by the protein(s) of interest expressed on said chip. The membrane protein of interest may be alone (membrane protein) or associated with one or more membrane or perimembrane auxiliary subunits (membrane protein complex). By virtue of its specificity, this chip allows, moreover, the use of large amounts of biological samples to be tested and does not impose, in the context of its use, any step of dilution of said biological sample. It is thus now possible to detect the presence of antibodies even when their concentration in the sample to be tested is very low.

A particular subject of the invention relates to a protein chip for the simple and effective identification of antibodies, preferably of autoantibodies, in a biological sample, said chip comprising at least one solubilized protein of interest, typically at least one solubilized membrane protein of interest, preferably chosen from an ion channel protein, a transporter protein and a membrane receptor protein which regulates the activity of an ion channel protein or of a transporter protein, said protein being optionally associated with one or more auxiliary subunits, and said chip being in the form of a support for detection of the complexes formed between antibodies, preferably autoantibodies, and (sequential and also conformational) epitopes specific for said protein, optionally associated with its auxiliary subunit(s). Preferably, said at least one protein or said at least one membrane protein complex is expressed in the nervous system of a human being and is preferably involved or suspected of being involved in the occurrence of an encephalopathy associated with neuronal excitability disorders.

Another subject of the invention relates to a protein chip comprising several different proteins of interest, typically several different membrane proteins of interest, typically at least 50 or at least 100 different proteins of interest, preferably between approximately 200 and approximately 400 different proteins of interest, for example approximately 250 or approximately 300 different proteins of interest, each protein of interest being optionally associated with one or more auxiliary subunits.

Moreover, the invention relates to a method for preparing a chip as described previously, and also the chip capable of being obtained by means of such a method, said method comprising the following steps of cloning the cDNA(s) of interest, of expressing the protein(s) (typically the membrane protein(s)) encoded by said cDNA(s) in cells in culture, of solubilizing the proteins expressed using a non-denaturing detergent which enables the solubilization of said proteins while at the same time preserving their native three-dimensional conformation and their ability to bind to a support, and of depositing said solubilized proteins on a support in order to obtain the chip of interest. Contrary to the invention, WO2004/108762 describes methods for preparing solubilized thyroid membrane which all require a fractionation step using salts in order to obtain a fraction enriched with proteins of interest, and also an ultracentrifugation step.

The invention also relates to the use of a chip according to the invention for screening for antibodies of interest, preferably for an antibody involved in the occurrence of an autoimmune disease, or for the diagnosis and/or the monitoring of the progression of an autoimmune disease.

Another subject of the invention relates, moreover, to a kit comprising a chip as described previously and, optionally, one or more reagents preferably chosen from a buffer for blocking the non-specific sites, a buffer allowing the association between antibodies and antigens (Ab/Ag), a washing buffer, a secondary antibody, one or more product(s) for detecting said secondary antibody or antibodies, and instructions for use.

DETAILED DESCRIPTION

Products

The invention relates to a protein chip for detecting antibodies, typically autoantibodies, preferably autoantibodies directed against membrane proteins and/or membrane protein complexes, in a biological sample, and also the method for obtaining same and the uses thereof. More specifically, the invention relates to a protein chip for detecting autoantibodies, in particular identifying new autoantibodies, in a biological sample. The inventors describe, for the first time, in the context of the present invention, a chip in the form of a support comprising at least one solubilized protein of interest (typically a solubilized membrane protein of interest), preferably a protein having retained its native three-dimensional structure (or conformation), and allowing the detection of the complexes formed between antibodies, typically autoantibodies, and epitopes (sequential or conformational), typically conformational epitopes, specific for said protein of interest.

The present invention allows, for the first time, the detection, which is at the same time sensitive and specific, of the complexes formed between autoantibodies and epitopes (sequential and conformational) of the membrane protein of interest (optionally associated with its auxiliary subunit(s)), preferably of a protein or of a protein complex involved or suspected of being involved in the occurrence of an encephalopathy associated with neuronal excitability disorders. In addition, this method makes it optional to dilute the biological sample tested.

The term "biological sample" encompasses any sample (fluid, tissue or cell) derived from an animal, typically from a mammal, from a lagomorph or from a rodent (rat, mouse, hamster, guinea pig), preferably from a human being. The biological sample is preferably a fluid, typically a fluid containing autoantibodies produced by said animal. The biological sample can be obtained directly from said animal or could be derived from a cell culture obtained from said animal. The biological samples are preferably chosen, for example, from blood, serum, plasma, cerebrospinal fluid (CSF), inner ear endolymph, inner ear perilymph, and a subfraction or a product derived therefrom. A preferred biological sample is a cerebrospinal fluid sample. The biological sample may have been subjected to a treatment such as a dilution in an acceptable vehicle. However, the present invention advantageously makes it possible to dispense with such a step.

The term "autoantibody" comprises any antibody and also any antibody fragment or portions such as Fab, F(ab')2, Fv and scFv which bind to an epitope of a self protein.

The term "protein" covers any amino acid sequence, or set of amino acid sequences, comprising at least one antigen comprising at least one epitope. In the context of the present invention, the term "protein" typically covers a membrane protein or a membrane protein complex as defined previously.

The term "solubilized protein" denotes a protein having been exposed to a non-denaturing detergent, i.e., a non-ionic detergent (also identified as "mild detergent"), allowing the solubilization of said protein while at the same time preserving its conformation (three-dimensional structure) and its ability to bind to a support. This mild solubilization is the first step used for the purification of the membrane proteins and then subsequently their functional analysis.

The term "antigen" denotes a natural or synthetic macromolecule recognized by antibodies or cells of the immune system and capable of generating an immune response.

The term "epitope" (or "antigenic determinant") denotes an immunoreactive sequence of amino acids, i.e., an amino acid sequence capable, by virtue of its structure, of specifically interacting with a particular antibody.

The same antigen may comprise several (identical or different) epitopes and thus induce varied immune responses. Sequential epitopes, corresponding to an amino acid sequence, and conformational epitopes, related to the authentic structure (spatial conformation or native three-dimensional conformation) of the protein, exist.

For the purposes of the invention, a protein can thus, for example, consist of a single-chain polypeptide; a set of polypeptides connected by covalent or non-covalent bonds; a protein portion, such as a subunit, a domain or a fragment; or a modified protein, for example modified by glycosylation (glycoprotein) or by combination with a lipid (lipoprotein). The term "protein" also covers the variants, derivatives and analogues of a particular protein.

The term "variant" or "derivative" is intended to mean any amino acid sequence which has been spontaneously modified (natural variant) or intentionally modified (artificial variant) compared with the specific amino acid sequence encoding the particular protein, such that the protein variant retains at least one of the endogenous functions of said particular protein, for example all of the endogenous functions of this particular protein (functionally equivalent protein). A variant can be obtained by addition or insertion, deletion and/or substitution of one or more amino acid residue(s) within the specific amino acid sequence encoding the particular protein.

The choice of the substitution amino acid can be decided on the basis of similarity of polarity, charge, solubility, hydrophobicity, hydrophilicity and/or of amphipathic nature guaranteeing the preservation of a particular function (e.g., transport function or transport activity modulating function). Negatively charged amino acids include, for example, aspartic acid and glutamic acid; positively charged amino acids include, for example, lysine and arginine; and uncharged amino acids having a similar hydrophilic nature include, for example, leucine, isoleucine, valine, glycine, alanine, asparagine, glutamine, serine, threonine, phenylalanine and tyrosine. Conservative substitutions can also be made, for example according to Table 1 below. The amino acids identified in the same block in the second column and preferably belonging to the same line in the third column can, for example, substitute for one another.

TABLE 1

| ALIPHATIC | Non-polar | G A P |
| | | I L V |
| | Polar-Uncharged | C S T M |
| | | N Q |
| | Polar-charged | D E |
| | | K R |
| AROMATIC | | H F W Y |

The term "analogue" is intended to mean any mimetic which is a naturally existing or artificially produced chemical compound which has at least one of the endogenous functions of the protein that it mimics, for example all of the endogenous functions of the protein that it mimics (functionally equivalent protein).

Generally, an epitope consists of a sequence of at least 3 to 4 amino acids, and more commonly of at least 5 to 6 amino acids. The epitopes may also consist of a sequence of approximately 7 to 8 amino acids, of even of approximately 10 amino acids. In the case of a sequential epitope, the amino acids are consecutive within the linear amino acid sequence of the protein. Conversely, as explained previously, the amino acids of a conformational epitope are not necessarily all consecutive within the linear amino acid sequence of the protein, the conformational epitope depending on the structure of the protein. In the context of the present invention, a particular epitope of a given protein denotes a (linear or conformational) particular amino acid sequence and also the immunological equivalents of the latter.

In one particular embodiment, the invention relates to a protein chip for detecting antibodies, typically autoantibodies, in a biological sample, said chip comprising at least one solubilized protein of interest (preferably a protein having retained its three-dimensional structure), typically at least one solubilized membrane protein of interest chosen, for example, from an ion channel protein, a transporter protein, and a membrane receptor protein which regulates the activity of an ion channel protein or of a transporter protein, said protein being optionally, when it corresponds to a main subunit, associated with one or more auxiliary subunits, and said chip being in the form of a support for detection of the complexes formed between antibodies and epitopes specific for said protein, the latter being optionally associated with its auxiliary subunit(s).

The term "ion channel protein" denotes a membrane protein which allows the passive passage of one or more ions. Ion channel proteins capable of being bound to the surface of the protein chip according to the invention can be chosen, for example, from ion channels and channel receptors.

Examples of ion channels are potassium channels (intracellular calcium-activated potassium channel, inwardly rectifying potassium channel, two-P-domain potassium channel, etc.), calcium channels, sodium channels and chloride channels. The ion channel may be a voltage gated channel.

Examples of channel receptors are the acetylcholine receptor, the glutamate receptor, the γ-aminobutyric acid (GABA) receptor and the adenosine-5'-triphosphate (ATP) receptor.

The term "transporter protein" denotes a protein intrinsic to the lipid cell membrane which allows the selective passage of water, of ions and/or of metabolites. Transporter proteins capable of being bound to the surface of the protein chip according to the invention can be chosen from, for example, aquaporins, connexins, Na+/K+ ATPases (or Na+/K+ pumps), H+/K+ ATPases (or H+/K+ pumps), Na+/H+ exchangers, Na+/Ca++ exchangers, and Na—K—Cl cotransporters.

The expression "membrane receptor protein which regulates the activity of an ion channel protein or of a transporter protein" or "regulatory membrane receptor protein" denotes any membrane protein, optionally associated with an ion channel protein and/or with a transporter protein, which regulates at least one activity of said proteins. Regulatory proteins of membrane receptor type which are capable of being bound to the surface of the protein chip according to the invention can be chosen, for example, from seven-transmembrane domains, G protein-coupled receptors and receptors of tyrosine kinase type.

As indicated above, said at least one protein of interest deposited on the support typically corresponds to a single-stranded protein (peptide) in its three-dimensional configuration, to the main subunit of a multistrand protein (polypeptide) in its natural configuration, i.e., three-dimensional configuration, or else to one of the main subunits of such a multistrand protein. This protein of interest may, however, correspond to or be associated with one or more auxiliary subunits of a set of functionally associated proteins (protein complex).

The term "auxiliary subunit" denotes the secondary parts of a protein or a protein complex, i.e., the parts other than the main subunit(s). The auxiliary subunit may be a membrane or perimembrane subunit. The auxiliary subunits of a protein often make it possible to regulate the activity (i.e., at least one of the functions) or a property (i.e., a functional characteristic) of said protein. In the case of an ion channel or of a transporter protein, for example, the main subunit generally allows the passage of ions or of metabolites, while the auxiliary subunits regulate this passage. Chaperone proteins and ionotropic receptors ("ionophores") are examples of auxiliary subunits of a protein complex.

Preferably, the protein of interest is expressed in the cells of the nervous system of an animal, typically of a mammal, of a rodent (rat, mouse, hamster, guinea pig) or of a lagomorph, preferably of a human being. The protein of interest is thus preferably a human protein. It may also be a protein originating from an animal other than a human being, such as those previously identified. Preferably, such an animal protein has a sequence sufficiently close to that of the corresponding human isoform to enable the recognition, by the antibodies of the immune system of a human being, of at least one conformational epitope of said animal protein. Typically, the animal protein of interest exhibits a homology between its linear sequence and that of the human isoform of at least 50%, preferably of at least 75%, even more preferably of at least 95%.

The protein of interest is typically a human membrane protein selected from a pentameric receptor (or "cys-loop" receptor), an ATP receptor, an ionotropic glutamate receptor, a voltage gated channel, for example a voltage gated calcium, sodium or potassium channel, an intracellular calcium-activated potassium channel, an inwardly rectifying potassium channel, a two-P-domain potassium channel, a cyclic nucleotide-activatable ion channel, a TRP (Transient Receptor Potential) ion channel, a chloride channel, an acid-sensitive cation channel, a sodium channel auxiliary subunit, and a calcium channel auxiliary subunit.

As previously indicated, the protein of interest may also be a rodent protein, typically a mouse or rat protein. Membrane proteins of interest originating from rodents can, for example, be chosen from a rat sodium channel, a rat calcium channel and a rat glutamate channel.

In the context of the present invention, the protein of interest, typically the membrane protein of interest, is preferably associated (or suspected of being associated) with a human pathological condition responsible for the appearance of autoantibodies.

In one particular embodiment of the invention, the protein of interest, typically the membrane protein of interest, is advantageously associated (or suspected of being associated) with an autoimmune (or presumed autoimmune) disease or pathological condition affecting the nervous system (neurological disease).

Examples of autoimmune pathological conditions affecting the nervous system comprise encephalopathies associated with neuronal excitability disorders, typically with neuronal receptor excitability disorders, and include, without being limited thereto, acquired epileptic syndromes, encephalitis, paraneoplastic neurological syndromes (PNSs), and non-paraneoplastic neurological syndromes with autoantibodies. Examples of convulsive or non-convulsive antoimmune (or presumed autoimmune) encephalopathies associated with neuronal excitability disorders are limbic encephalitis (which involves autoantibodies directed against proteins associated with voltage gated potassium channels or autoantibodies directly directed against these channels), Rasmussen encephalitis (associated with antibodies directed against glutamate receptors and acetylcholine receptors), post-infectious encephalitis, anti-NMDA receptor (anti-NMDAR) antibody encephalitis, Morvan's syndrome, Devic's disease or Devic's neuromyelitis optica (which involves autoantibodies directed against aquaporin-4), opsoclonus myoclonus syndromes in children (of post-infectious or paraneoplastic origin), encephalomyelitis, acquired epileptic syndromes, and paraneoplastic neurological syndromes (PNSs). Preferentially, the encephalopathy is an attack on the central nervous system which may be associated with neuronal excitability disorders of (demonstrated or suspected) autoimmune origin and of post-infectious or paraneoplastic origin.

In another particular embodiment of the invention, the protein of interest, typically the membrane protein of interest, is a protein associated (or suspected of being associated) with a peripheral neurological syndrome (possibly associated with an encephalopathy) of (demonstrated or suspected) autoimmune origin, and typically of post-infectious or paraneoplastic origin. The peripheral neurological syndromes may be responsible for muscle paralysis of pre- or post-synaptic origin. Isaacs' syndrome is an example of a peripheral neurological syndrome.

In another particular embodiment of the invention, the protein of interest, typically the membrane protein of interest, is a protein associated (or suspected of being associated) with a neurosensory disease (possibly associated with sensory receptor excitability disorders), for example with an inner ear disease, such as Ménière's disease or acquired or presumed congenital deafness.

A particular chip according to the invention comprises at least one membrane protein of interest, typically several membrane proteins of interest, said protein being encoded by a human cDNA sequence chosen from the nucleotide sequences identified in Table 2 below or corresponding to an amino acid sequence chosen from the amino acid sequences also identified in Table 2 below, preferably from the amino acid sequences SEQ ID NO: 1 to SEQ ID NO: 311.

TABLE 2

| Gene | Complete name of the gene | Nucleotide Seq Ref (isoforms) | Amplified gene size (bp) | Protein Seq Ref (isoforms) and associated SEQ ID NOs |
|---|---|---|---|---|
| "Cys-loop" receptors | | | | |
| HTR3A | serotonin 5-HT3 receptor A subunit | NM_000869 (Hs), NM_213621 (Hs), NM_013561 (Mm), NM_001099644 (Mm), NM_024394 (Rn) | 1537 | NP_000860 (Hs) (SEQ ID NO: 1), NP_998786 (Hs) (SEQ ID NO: 2), NP_038589 (Mm), NP_001093114 (Mm), NP_077370 (Rn) |
| HTR3B | serotonin 5-HT3 receptor B subunit | NM_006028 (Hs), NM_020274 (Mm), NM_022189 (Rn) | 1333 | NP_006019 (Hs) (SEQ ID NO: 3), NP_064670 (Mm), NP_071525 (Rn) |
| HTR3C | serotonin 5-HT3 receptor C subunit | NM_130770 | 1348 | NP_570126 (Hs) (SEQ ID NO: 4) |
| HTR3D | serotonin 5-HT3 receptor D subunit | NM_182537 | 844 | NP_872343 (Hs) (SEQ ID NO: 5) |
| HTR3E | serotonin 5-HT3 receptor E subunit | NM_182589 | 1420 | NP_872395 (Hs) (SEQ ID NO: 6) |
| CHRNA1 | nicotinic acetylcholine receptor α1 subunit | NM_001039523 (Hs), NM_007389 (Mm), NM_024485 (Rn) | 1450 | NP_001034612 (Hs) (SEQ ID NO: 7), NP_031415 (Mm), NP_077811 (Rn) |
| CHRNA2 | nicotinic acetylcholine receptor α2 subunit | NM_000742 (Hs), NM_144803 (Mm), NM_133420 (Rn) | 1591 | NP_000733 (Hs) (SEQ ID NO: 8), NP_659052 (Mm), NP_596911 (Rn) |
| CHRNA3 | nicotinic acetylcholine receptor α3 subunit | NM_000743 (Hs), NM_145129 (Mm), NM_052805 (Rn) | 1519 | NP_000734 (Hs) (SEQ ID NO: 9), NP_660111 (Mm), NP_434692 (Rn) |
| CHRNA4 | nicotinic acetylcholine receptor α4 subunit | NM_000744 (Hs), NM_015730 (Mm), NM_024354 (Rn) | 1885 | NP_000735 (Hs) (SEQ ID NO: 10), NP_056545 (Mm), NP_077330 (Rn) |
| CHRNA5 | nicotinic acetylcholine receptor α5 subunit | NM_000745 (Hs), NM_176844 (Mm), NM_017078 (Rn) | 1407 | NP_000736 (Hs) (SEQ ID NO: 11), NP_789814 (Mm), NP_058774 (Rn) |
| CHRNA6 | nicotinic acetylcholine receptor α6 subunit | NM_004198 (Hs), NM_021369 (Mm), NM_057184 (Rn) | 1489 | NP_004189 (Hs) (SEQ ID NO: 12), NP_067344 (Mm), NP_476532 (Rn) |
| CHRNA7 | nicotinic acetylcholine receptor α7 subunit | NM_000746 (Hs), NM_007390 (Mm), NM_012832 (Rn) | 1513 | NP_000737 (Hs) (SEQ ID NO: 13), NP_031416 (Mm), NP_036964 (Rn) |
| CHRNA9 | nicotinic acetylcholine receptor α9 subunit | NM_017581 (Hs), NM_001081104 (Mm), NM_022930 (Rn) | 1444 | NP_060051 (Hs) (SEQ ID NO: 14), NP_001074573 (Mm), NP_075219 (Rn) |
| CHRNA10 | nicotinic acetylcholine receptor α10 subunit | NM_020402 (Hs), NM_001081424 (Mm), NM_022639 (Rn) | 1354 | NP_065135 (Hs) (SEQ ID NO: 15), NP_001074893 (Mm), NP_072161 (Rn) |
| CHRNB1 | nicotinic acetylcholine receptor β1 subunit | NM_000747 (Hs), NM_009601 (Mm), NM_012528 (Rn) | 1510 | NP_000738 (Hs) (SEQ ID NO: 16), NP_033731 (Mm), NP_036660 (Rn) |
| CHRNB2 | nicotinic acetylcholine receptor β2 subunit | NM_000748 (Hs), NM_009602 (Mm), NM_019297 (Rn) | 1510 | NP_000739 (Hs) (SEQ ID NO: 17), NP_033732 (Mm), NP_062170 (Rn) |
| CHRNB3 | nicotinic acetylcholine receptor β3 subunit | NM_000749 (Hs), NM_173212 (Mm), NM_133597 (Rn) | 1381 | NP_000740 (Hs) (SEQ ID NO: 18), NP_775304 (Mm), NP_598281 (Rn) |
| CHRNB4 | nicotinic acetylcholine receptor β4 subunit | NM_000750 (Hs), NM_148944 (Mm), NM_052806 (Rn) | 1501 | NP_000741 (Hs) (SEQ ID NO: 19), NP_683746 (Mm), NP_434693 (Rn) |

TABLE 2-continued

| Gene | Complete name of the gene | Nucleotide Seq Ref (isoforms) | Amplified gene size (bp) | Protein Seq Ref (isoforms) and associated SEQ ID NOs |
|---|---|---|---|---|
| CHRND | nicotinic acetylcholine receptor δ subunit | NM_000751 (Hs), NM_021600 (Mm), NM_019298 (Rn) | 1555 | NP_000742 (Hs) (SEQ ID NO: 20), NP_067611 (Mm), NP_062171 (Rn) |
| CHRNE | nicotinic acetylcholine receptor ε subunit | NM_000080 (Hs), NM_009603 (Mm), NM_017194 (Rn) | 1483 | NP_000071 (Hs) (SEQ ID NO: 21), NP_033733 (Mm), NP_058890 (Rn) |
| CHRNG | nicotinic acetylcholine receptor γ subunit | NM_005199 (Hs), NM_009604 (Mm), NM_019145 (Rn) | 1558 | NP_005190 (Hs) (SEQ ID NO: 22), NP_033734 (Mm), NP_062018 (Rn) |
| GABRA1 | GABA receptor α1 subunit | NM_000806 (Hs), NM_010250 (Mm), NM_183326 (Rn) | 1375 | NP_000797 (Hs) (SEQ ID NO: 23), NP_034380 (Mm), NP_899155 (Rn) |
| GABRA2 | GABA receptor α2 subunit | NM_000807 (Hs), NM_008066 (Mm) | 1360 | NP_000798 (Hs) (SEQ ID NO: 24), NP_032092 (Mm) |
| GABRA3 | GABA receptor α3 subunit | NM_000808 (Hs), NM_008067 (Mm), NM_017069 (Rn) | 1483 | NP_000799 (Hs) (SEQ ID NO: 25), NP_032093 (Mm), NP_058765 (Rn) |
| GABRA4 | GABA receptor α4 subunit | NM_000809 (Hs), NM_010251 (Mm), NM_080587 (Rn) | 1666 | NP_000800 (Hs) (SEQ ID NO: 26), NP_034381 (Mm), NP_542154 (Rn) |
| GABRA5 | GABA receptor α5 subunit | NM_000810 (Hs), NM_176942 (Mm), NM_017295 (Rn) | 1390 | NP_000801 (Hs) (SEQ ID NO: 27), NP_795916 (Mm), NP_058991 (Rn) |
| GABRA6 | GABA receptor α6 subunit | NM_000811 (Hs), NM_001099641 (Mm), NM_021841 (Rn) | 1363 | NP_000802 (Hs) (SEQ ID NO: 28), NP_001093111 (Mm), NP_068613 (Rn) |
| GABRB1 | GABA receptor β1 subunit | NM_000812 (Hs), NM_008069 (Mm), NM_012956 (Rn) | 1429 | NP_000803 (Hs) (SEQ ID NO: 29), NP_032095 (Mm), NP_037088 (Rn) |
| GABRB2 | GABA receptor β2 subunit | NM_021911 (Hs), NM_000813 (Hs), NM_008070 (Mm), NM_012957 (Rn) | 1543 | NP_068711 (Hs) (SEQ ID NO: 30), NP_000804 (Hs) (SEQ ID NO: 31), NP_032096 (Mm), NP_037089 (Rn) |
| GABRB3 | GABA receptor β3 subunit | NM_000814 (Hs), NM_008071 (Mm), NM_017065 (Rn) | 1426 | NP_000805 (Hs) (SEQ ID NO: 32), NP_032097 (Mm), NP_058761 (Rn) |
| GABRD | GABA receptor δ subunit | NM_000815 (Hs), NM_008072 (Mm), NM_017289 (Rn) | 1360 | NP_000806 (Hs) (SEQ ID NO: 33), NP_032098 (Mm), NP_058985 (Rn) |
| GABRE* | GABA receptor ε subunit * | NM_004961 (Hs), NM_017369 (Mm), NM_023091 (Rn) | 1525 | NP_004952 (Hs) (SEQ ID NO: 34), NP_059065 (Mm), NP_075579 (Rn) |
| GABRG1 | GABA receptor γ1 subunit | NM_173536 (Hs), NM_010252 (Mm), NM_080586 (Rn) | 1399 | NP_775807 (Hs) (SEQ ID NO: 35), NP_034382 (Mm), NP_542153 (Rn) |
| GABRG2 | GABA receptor γ2 subunit | NM_198904 (Hs), NM_008073 (Mm), NM_183327 (Rn) | 1432 | NP_944494 (Hs) (SEQ ID NO: 36), NP_032099 (Mm), NP_899156 (Rn) |
| GABRG3 | GABA receptor γ3 subunit | NM_033223 (Hs), NM_008074 (Mm), NM_024370 (Rn) | 1405 | NP_150092 (Hs) (SEQ ID NO: 37), NP_032100 (Mm), NP_077346 (Rn) |
| GABRP | GABA receptor π subunit | NM_014211 (Hs), NM_146017 (Mm), NM_031029 (Rn) | 1183 | NP_055026 (Hs) (SEQ ID NO: 38), NP_666129 (Mm), NP_112291 (Rn) |
| GABRR1 | GABA receptor ρ1 subunit | NM_002042 (Hs), NM_008075 (Mm), NM_017291 (Rn) | 1322 | NP_002033 (Hs) (SEQ ID NO: 39), NP_032101 (Mm), NP_058987 (Rn) |
| GABRR2 | GABA receptor ρ2 subunit | NM_002043 (Hs), NM_008076 (Mm), NM_017292 (Rn) | 1474 | NP_002034 (Hs) (SEQ ID NO: 40), NP_032102 (Mm), NP_058988 (Rn) |
| GABRR3 | GABA receptor ρ3 subunit | NM_001105580 (Hs), NM_001081190 (Mm), NM_138897 (Rn) | 1405 | NP_001099050 (Hs) (SEQ ID NO: 41), NP_001074659 (Mm), NP_620252 (Rn) |
| GABRQ | GABA receptor θ subunit | NM_018558 (Hs), NM_020488 (Mm), NM_031733 (Rn) | 1183 | NP_061028 (Hs) (SEQ ID NO: 42), NP_065234 (Mm), NP_113921 (Rn) |
| GLRA1 | glycine receptor α1 subunit | NM_000171 (Hs), NM_020492 (Mm), NM_013133 (Rn) | 1354 | NP_000162 (Hs) (SEQ ID NO: 43), NP_065238 (Mm), NP_037265 (Rn) |
| GLRA2 | glycine receptor α2 subunit | NM_002063 (Hs), NM_183427 (Mm), NM_012568 (Rn) | 1363 | NP_002054 (Hs) (SEQ ID NO: 44), NP_906272 (Mm), NP_036700 (Rn) |
| GLRA3 | glycine receptor α3 subunit | NM_006529 (Hs), NM_080438 (Mm), NM_053724 (Rn) | 1396 | NP_006520 (Hs) (SEQ ID NO: 45), NP_536686 (Mm), NP_446176 (Rn) |
| GLRA4 | glycine receptor α4 subunit | NM_001024452.2 (Hs), NM_010297 (Mm) | 1135 | NP_001019623 (Hs) (SEQ ID NO: 46), NP_034427 (Mm), XP_346351.2 (Rn) |
| GLRB | glycine receptor β subunit | NM_000824 (Hs), NM_010298 (Mm), NM_053296 (Rn) | 1498 | NP_000815 (Hs) (SEQ ID NO: 47), NP_034428 (Mm), NP_445748 (Rn) |
| ATP receptors | | | | |
| P2RX1 | ATP receptor P2X1 subunit | NM_002558 (Hs), NM_008771 (Mm), NM_012997 (Rn), AF231010 (Rn) | 1201 | NP_002549 (Hs) (SEQ ID NO: 48), NP_032797 (Mm), NP_037129 (Rn), Q9JIF8 (Rn) |
| P2RX2 | ATP receptor P2X2 subunit Isoform A | AF190824 (Hs), AF190823 (Hs), AF190825 (Hs), NM_170682 (Hs), NM_153400 (Mm), NM_053656 (Rn) | 1417 | AAF19173 (Hs) (SEQ ID NO: 49), NP_733782 (Hs) (SEQ ID NO: 50), AAF19171 (Hs) (SEQ ID NO: 51), AAF19172 (Hs) (SEQ ID NO: 52), NP_700449 (Mm), NP_446108 (Rn) |
| P2RX3 | ATP receptor P2X3 subunit | NM_002559 (Hs), NM_145526 (Mm), NM_031075 (Rn) | 1198 | NP_002550 (Hs) (SEQ ID NO: 53), NP_663501 (Mm), NP_112337 (Rn) |
| P2RX4 | ATP receptor P2X4 subunit | NM_002560 (Hs), NM_011026 (Mm), NM_031594 (Rn) | 1168 | NP_002551 (Hs) (SEQ ID NO: 54), NP_035156 (Mm), NP_113782 (Rn) |
| P2RX5 | ATP receptor P2X5 subunit isoform A | NM_002561 (Hs), NM_033321 (Mm), NM_080780 (Rn) | 1270 | NP_002552 (Hs) (SEQ ID NO: 55), NP_201578 (Mm), NP_542958 (Rn) |

TABLE 2-continued

| Gene | Complete name of the gene | Nucleotide Seq Ref (isoforms) | Amplified gene size (bp) | Protein Seq Ref (isoforms) and associated SEQ ID NOs |
|---|---|---|---|---|
| P2RXL1 | ATP receptor P2X6 subunit (aka P2XM, and P2X-like 1) | NM_005446 (Hs), NM_011028 (Mm), NM_012721 (Rn) | 1330 | NP_005437 (Hs) (SEQ ID NO: 56), NP_035158 (Mm), NP_036853 (Rn) |
| P2RX7 | ATP receptor P2X7 subunit | NM_002562 (Hs), NM_011027 (Mm), FJ436444 (Mm), NM_019256 (Rn), FJ436445 (Rn) | 1792 | NP_002553 (Hs) (SEQ ID NO: 57), NP_035157 (Mm), ACR61395 (Mm), ACR61396 (Rn), NP_062129 (Rn) |
| Ionotropic glutamate receptors | | | | |
| Orphan GRID1 | glutamate receptor δ1 subunit | NM_017551 (Hs), NM_008166 (Mm), NM_024378 (Rn) | 3031 | NP_060021 (Hs) (SEQ ID NO: 58), NP_032192 (Mm), NP_077354 (Rn) |
| Orphan GRID2 | glutamate receptor δ2 subunit | NM_001510 (Hs), NM_008167 (Mm), NM_024379 (Rn) | 3025 | NP_001501 (Hs) (SEQ ID NO: 59), NP_032193 (Mm), NP_077355 (Rn) |
| Kainate GRIK4 | glutamate receptor KA1 subunit (aka EAA1) | NM_014619 (Hs), NM_175481 (Mm), NM_012572 (Rn) | 1875 | NP_055434 (Hs) (SEQ ID NO: 60), NP_780690 (Mm), NP_036704 (Rn) |
| Kainate GRIK5 | glutamate receptor KA2 subunit (aka EAA2) | NM_002088 (Hs), NM_008168 (Mm), NM_031508 (Rn) | 2947 | NP_002079 (Hs) (SEQ ID NO: 61), NP_032194 (Mm), NP_113696 (Rn) |
| NMDA GRIN1 | glutamate receptor NMDAR1 subunit | NM_007327 (Hs), NM_008169 (Mm), NM_017010 (Rn) | 2665 | NP_015566 (Hs) (SEQ ID NO: 62), NP_032195 (Mm), NP_058706 (Rn) |
| NMDA GRIN2A | glutamate receptor NMDAR2A subunit | NM_000833 (Hs), NM_008170 (Mm), NM_012573 (Rn) | 4396 | NP_000824 (Hs) (SEQ ID NO: 63), NP_032196 (Mm), NP_036705 (Rn) |
| NMDA GRIN2B | glutamate receptor NMDAR2B subunit | NM_000834 (Hs), NM_008171 (Mm), NM_012574 (Rn) | 4459 | NP_000825 (Hs) (SEQ ID NO: 64), NP_032197 (Mm), NP_036706 (Rn) |
| NMDA GRIN2C | glutamate receptor NMDAR2C subunit | NM_000835 (Hs), NM_010350 (Mm), NM_012575 (Rn) | 3706 | NP_000826 (Hs) (SEQ ID NO: 65), NP_034480 (Mm), NP_036707 (Rn) |
| NMDA GRIN2D | glutamate receptor NMDAR2D subunit | NM_000836 (Hs), NM_008172 (Mm), NM_022797 (Rn) | 4015 | NP_000827 (Hs) (SEQ ID NO: 66), NP_032198 (Mm), NP_073634 (Rn) |
| NMDA GRIN3A | glutamate receptor NMDAR3A subunit | NM_133445 (Hs), NM_001033351 (Mm) | 3352 | NP_597702 (Hs) (SEQ ID NO: 67), NP_001028523 (Mm) |
| NMDA GRIN3B | glutamate receptor NMDAR3B subunit (aka χ-2) | NM_138690 (Hs), NM_130455 (Mm), NM_133308 (Rn) | 3133 | NP_619635 (Hs) (SEQ ID NO: 68), NP_569722 (Mm), NP_579842 (Rn) |
| AMPA GRIA1 | glutamate receptor GLUR1 subunit (aka KR4, HBGR1, GluHI) | NM_000827 (Hs), NM_001114183 (Hs), NM_008165 (Mm), NM_001113325 (Mm), NM_031608 (Rn) | 2725 | NP_000818 (Hs) (SEQ ID NO: 69), NP_001107655 (Hs) (SEQ ID NO: 70), NP_001106796 (Mm), NP_032191 (Mm), NP_113796 (Rn) |
| AMPA GRIA2 | glutamate receptor GLUR2 subunit | NM_001083619 (Hs), NM_000826 (Hs), NM_013540 (Mm), NM_001083806 (Mm), NM_001039195 (Mm), NM_017261 (Rn), NM_001083811 (Rn) | 2656 | NP_000817 (Hs) (SEQ ID NO: 71), NP_001077088 (Hs) (SEQ ID NO: 72), NP_001077275 (Mm), NP_001034284 (Mm), NP_038568 (Mm), NP_058957 (Rn), NP_001077280 (Rn) |
| AMPA GRIA3 | glutamate receptor GLUR3 subunit (aka GLURC) | NM_007325 (Hs), NM_000828 (Hs), NM_016886 (Mm), NM_001112742 (Rn), NM_032990 (Rn) | 2686 | NP_015564 (Hs) (SEQ ID NO: 73), NP_000819 (Hs) (SEQ ID NO: 74), NP_058582 (Mm), NP_116785 (Rn), NP_001106213 (Rn) |
| AMPA GRIA4 | glutamate receptor GluR4 subunit | NM_001077243 (Hs), NM_000829 (Hs), NM_001077243 (Hs), NM_000829 (Hs), NM_001113180 (Mm), NM_019691 (Mm), NM_001113184 (Rn), NM_017263 (Rn) | 2713 | NP_000820 (Hs) (SEQ ID NO: 75), NP_001070711 (Hs) (SEQ ID NO: 76), NP_000820 (Hs), NP_001070711 (Hs), NP_062665 (Mm), NP_001106651 (Mm), NP_058959 (Rn), NP_001106655 (Rn) |
| Kainate GRIK1 | glutamate receptor GLUR5 subunit (aka EEA3) | NM_175611 (Hs), NM_010348 (Mm), NM_017241 (Rn) | 2761 | NP_783300 (Hs) (SEQ ID NO: 77), NP_034478 (Mm), NP_058937 (Rn) |
| Kainate GRIK2 | glutamate receptor GLUR6 subunit (aka EAA4 aka β2) | NM_021956 (Hs), NM_010349 (Mm), NM_019309 (Rn) | 2731 | NP_068775 (Hs) (SEQ ID NO: 78), NP_034479 (Mm), NP_062182 (Rn) |
| Kainate GRIK3 | glutamate receptor GLUR7 subunit (aka EAA5) | NM_000831 (Hs), NM_001081097 (Mm), NM_001112716 (Rn) | 2764 | NP_000822 (Hs) (SEQ ID NO: 79), NP_001074566 (Mm), NP_001106187 (Rn) |
| Voltage gated sodium channels | | | | |
| SCN1A | voltage gated sodium channel type I a subunit | NM_006920 (Hs), NM_018733 (Mm), NM_030875 (Rn) | 5998 | NP_008851 (Hs) (SEQ ID NO: 80), NP_061203 (Mm) (SEQ ID NO: 81), NP_110502 (Rn) (SEQ ID NO: 82) |
| SCN2A | voltage gated sodium channel type II a subunit | NM_001040143 (Hs), NM_001040142 (Hs), NM_001099298 (Mm), NM_012647 (Rn) | 6019 | NP_001035232 (Hs) (SEQ ID NO: 83), NP_001035233 (Hs) (SEQ ID NO: 84), NP_001092768 (Mm) (SEQ ID NO: 85), NP_036779 (Rn) (SEQ ID NO: 86) |
| SCN3A | voltage gated sodium channel type III a subunit | NM_006922 (Hs), NM_018732 (Mm), NM_013119 (Rn) | 6004 | NP_008853 (Hs) (SEQ ID NO: 87), NP_061202 (Mm) (SEQ ID NO: 88), NP_037251 (Rn) (SEQ ID NO: 89) |
| SCN4A | voltage gated sodium channel type IV a subunit | NM_000334 (Hs), NM_133199 (Mm), NM_013178 (Rn) | 5512 | NP_000325 (Hs) (SEQ ID NO: 90), NP_573462 (Mm) (SEQ ID NO: 91), NP_037310 (Rn) (SEQ ID NO: 92) |

TABLE 2-continued

| Gene | Complete name of the gene | Nucleotide Seq Ref (isoforms) | Amplified gene size (bp) | Protein Seq Ref (isoforms) and associated SEQ ID NOs |
|---|---|---|---|---|
| SCN5A | voltage gated sodium channel type V a subunit | NM_001099404 (Hs), NM_000335 (Hs), NM_198056 (Hs), NM_001099405 (Hs), NM_021544 (Mm), NM_013125 (Rn) | 6055 | NP_001092874 (Hs) (SEQ ID NO: 93), NP_001092875 (Hs) (SEQ ID NO: 94), NP000326 (Hs) (SEQ ID NO: 95), NP_932173 (Hs) (SEQ ID NO: 96), NP_067519 (Mm) (SEQ ID NO: 97), NP_037257 (Rn) (SEQ ID NO: 98) |
| SCN8A | voltage gated sodium channel type VIII a subunit | NM_014191 (Hs), NM_001077499 (Mm), NM_019266 (Rn) | 5944 | NP_055006 (Hs) (SEQ ID NO: 99), NP_001070967 (Mm) (SEQ ID NO: 100), NP_062139 (Rn) (SEQ ID NO: 101) |
| SCN9A | voltage gated sodium channel type IX a subunit | NM_002977 (Hs), NM_018852 (Mm), NM_133289 (Rn) | 5935 | NP_002968 (Hs) (SEQ ID NO: 102), NP_061340 (Mm) (SEQ ID NO: 103), NP_579823 (Rn) (SEQ ID NO: 104) |
| SCN10A | voltage gated sodium channel type X a subunit | NM_006514 (Hs), NM_009134 (Mm), NM_017247 (Rn) | 5872 | NP_006505 (Hs) (SEQ ID NO: 105), NP_033160 (Mm) (SEQ ID NO: 106), NP_058943 (Rn) (SEQ ID NO: 107) |
| SCN11A | voltage gated sodium channel type XI a subunit | NM_014139 (Hs), NM_011887 (Mm), NM_019265 (Rn) | 5377 | NP_054858 (Hs) (SEQ ID NO: 108), NP_036017 (Mm) (SEQ ID NO: 109), NP_062138 (Rn) (SEQ ID NO: 110) |
| Voltage gated calcium channels | | | | |
| CACNA1S | voltage gated calcium channel L-type a1S subunit | NM_000069 (Hs), NM_001081023 (Mm), NM_053873 (Rn) | 5626 | NP_000060 (Hs) (SEQ ID NO: 111), NP_001074492 (Mm) (SEQ ID NO: 112), NP_446325 (Rn) (SEQ ID NO: 113) |
| CACNA1C | voltage gated calcium channel L-type a1C subunit | NM_000719 (Hs), NM_009781 (Mm), NM_012517 (Rn) | 6418 | NP_000710 (Hs) (SEQ ID NO: 114), NP_033911 (Mm) (SEQ ID NO: 115), NP_036649 (Rn) (SEQ ID NO: 116) |
| CACNA1D | voltage gated calcium channel L-type a1D subunit | NM_000720 (Hs), NM_028981 (Mm), NM_017298 (Rn) | 6550 | NP_000711 (Hs) (SEQ ID NO: 117), NP_083257 (Mm) (SEQ ID NO: 118), NP_058994 (Rn) (SEQ ID NO: 119) |
| CACNA1F | voltage gated calcium channel L-type a1F subunit | NM_005183 (Hs), NM_019582 (Mm), NM_053701 (Rn) | 5938 | NP_005174 (Hs) (SEQ ID NO: 120), NP_062528 (Mm) (SEQ ID NO: 121), NP_446153 (Rn) (SEQ ID NO: 122) |
| CACNA1A | voltage gated calcium channel P/Q-type a1A subunit | NM_023035 (Hs), NM_000068.3 (Hs), NM_007578 (Mm), NM_012918 (Rn) | 6802 | NP_075461 (Hs) (SEQ ID NO: 123), NP_000059 (Hs) (SEQ ID NO: 124), NP_031604 (Mm) (SEQ ID NO: 125), NP_037050 (Rn) (SEQ ID NO: 126) |
| CACNA1B | voltage gated calcium channel N-type a1B subunit | NM_000718 (Hs), NM_001042528 (Mm), NM_147141 (Rn) | 7021 | NP_000709 (Hs) (SEQ ID NO: 127), NP_001035993 (Mm) (SEQ ID NO: 128), NP_671482 (Rn) (SEQ ID NO: 129) |
| CACNA1E | voltage gated calcium channel R-type a1E subunit | NM_000721 (Hs), NM_009782 (Mm), NM_019294 (Rn) | 6814 | NP_000712 (Hs) (SEQ ID NO: 130), NP_033912 (Mm) (SEQ ID NO: 131), NP_062167 (Rn) (SEQ ID NO: 132) |
| CACNA1G | voltage gated calcium channel T-type a1G subunit | NM_198378 (Hs), NM_198387 (Hs), NM_198379 (Hs), NM_938190 (Hs), NM_009783 (Mm), NM_031601 (Rn) | 7135 | NP_061496 (Hs) (SEQ ID NO: 133), NP_938192 (Hs) (SEQ ID NO: 134), NP_938190 (Hs) (SEQ ID NO: 135), NP_938201 (Hs) (SEQ ID NO: 136), NP_938193 (Hs) (SEQ ID NO: 137), NP_033913 (Mm) (SEQ ID NO: 138), NP_113789 (Rn) (SEQ ID NO: 139) |
| CACNA1H | voltage gated calcium channel T-type a1H subunit | NM_021098 (Hs), NM_021415 (Mm), NM_153814 (Rn) | 7069 | NP_066921 (Hs) (SEQ ID NO: 140), NP_067390 (Mm) (SEQ ID NO: 141), NP_722521 (Rn) (SEQ ID NO: 142) |
| CACNA1I | voltage gated calcium channel T-type a1I subunit | NM_001003406 (Hs), NM_021096 (Hs), NM_001044308 (Mm), NM_020084 (Rn) | 6673 | NP_066919 (Hs) (SEQ ID NO: 143), NP_001003406 (Hs) (SEQ ID NO: 144), NP_001037773 (Mm) (SEQ ID NO: 145), NP_064469 (Rn) (SEQ ID NO: 146) |
| Voltage gated potassium channels | | | | |
| Shaker KCNA1 | voltage gated Potassium channel Delayed Rectifier member 1 | NM_000217 (Hs), NM_010595 (Mm), NM_173095 (Rn) | 1492 | NP_000208 (Hs) (SEQ ID NO: 147), NP_034725 (Mm), NP_775118 (Rn) |
| Shaker KCNA2 | voltage gated Potassium channel Delayed Rectifier member 2 | NM_004974 (Hs), NM_008417 (Mm), NM_012970 (Rn) | 1504 | NP_004965 (Hs) (SEQ ID NO: 148), NP_032443 (Mm), NP_037102 (Rn) |
| Shaker KCNA3 | voltage gated Potassium channel Delayed Rectifier member 3 | NM_002232 (Hs), NM_008418 (Mm), NM_019270 (Rn) | 1729 | NP_002223 (Hs) (SEQ ID NO: 149), NP_032444 (Mm), NP_062143 (Rn) |
| Shaker KCNA4 | voltage gated Potassium channel A-Type, Fast inactivation member 4 | NM_002233 (Hs), NM_021275 (Mm), NM_012971 (Rn) | 1963 | NP_002224 (Hs) (SEQ ID NO: 150), NP_067250 (Mm), NP_037103 (Rn) |
| Shaker KCNA5 | voltage gated Potassium channel Delayed Rectifier member 5 | NM_002234 (Hs), NM_145983 (Mm), NM_012972 (Rn) | 1843 | NP_002225 (Hs) (SEQ ID NO: 151), NP_666095 (Mm), NP_037104 (Rn) |
| Shaker KCNA6 | voltage gated Potassium channel Delayed Rectifier member 6 | NM_002235 (Hs), NM_013568 (Mm), NM_023954 (Rn) | 1597 | NP_002226 (Hs) (SEQ ID NO: 152), NP_038596 (Mm), NP_076444 (Rn) |
| Shaker KCNA7 | voltage gated Potassium channel Delayed Rectifier member 7 | NM_031886 (Hs), NM_010596 (Mm), NM_001108914 (Rn) | 1375 | NP_114092 (Hs) (SEQ ID NO: 153), NP_034726 (Mm), NP_001102384 (Rn) |

TABLE 2-continued

| Gene | Complete name of the gene | Nucleotide Seq Ref (isoforms) | Amplified gene size (bp) | Protein Seq Ref (isoforms) and associated SEQ ID NOs |
|---|---|---|---|---|
| Shaker KCNA10 | voltage gated Potassium channel Delayed Rectifier member 10 | NM_005549 (Hs), NM_001074609 (Mm), XM_227577 (Rn) | 1537 | NP_005540 (Hs) (SEQ ID NO: 154), NP_001074609 (Mm), XP_227577 (Rn) |
| Shab KCNB1 | voltage gated Potassium channel Delayed Rectifier Shab Related member 1 | NM_004975 (Hs), NM_008420 (Mm), NM_013186 (Rn) | 2581 | NP_004966 (Hs) (SEQ ID NO: 155), NP_032446 (Mm), NP_037318 (Rn) |
| Shab KCNB2 | voltage gated Potassium channel Delayed Rectifier Shab Related member 2 | NM_004770 (Hs), NM_001098528 (Mm), NM_054000 (Rn) | 2737 | NP_004761 (Hs) (SEQ ID NO: 156), NP_001091998 (Mm), NP_446452 (Rn) |
| Shaw KCNC1 | voltage gated Potassium channel Delayed Rectifier Shaw Related member 1 | NM_004976 (Hs), NM_008421 (Mm), NM_001112739 (Mm), NM_139217.1 (Rn), NM_012856 (Rn) | 1537 | NP_004967 (Hs) (SEQ ID NO: 157), NP_032447 (Mm), NP_001106210 (Mm), NP_631963 (Rn), NP_036988 (Rn) |
| Shaw KCNC2 | voltage gated Potassium channel Delayed Rectifier Shaw Related member 2 | NM_153748 (Hs), NM_139136 (Hs), NM_139137 (Hs), NM_001025581 (Mm), NM_139217 (Rn), NM_139216 (Rn) | 1843 | NP_631875 (Hs) (SEQ ID NO: 158), NP_715624 (Hs) (SEQ ID NO: 159), NP_631874 (Hs) (SEQ ID NO: 160), NP_001020752 (Mm), NP_631962 (Rn), NP_631963 (Rn) |
| Shaw KCNC3 | voltage gated Potassium channel A-Type Shaw Related member 3 | NM_004977 (Hs), NM_008422 (Mm), NM_053997 (Rn) | 2278 | NP_004968 (Hs) (SEQ ID NO: 161), NP_032448 (Mm), NP_446449 (Rn) |
| Shaw KCNC4 | voltage gated Potassium channel A-Type Fast inactivation Shaw Related member 4 | NM_004978 (Hs), NM_145922 (Mm) | 1912 | NP_004969 (Hs) (SEQ ID NO: 162), NP_666034 (Mm), NP_001116248 (Rn) |
| Shal KCND1 | voltage gated Potassium channel A-Type Shal Related member 1 | NM_004979 (Hs), NM_008423 (Mm), NM_001105748 (Rn) | 1948 | NP_004970 (Hs) (SEQ ID NO: 163), NP_032449 (Mm), NP_001099218 (Rn) |
| Shal KCND2 | voltage gated Potassium channel A-Type Shal Related member 2 | NM_012281 (Hs), NM_019697 (Mm), NM_031730 (Rn) | 1894 | NP_036413 (Hs) (SEQ ID NO: 164), NP_062671 (Mm), NP_113918 (Rn) |
| Shal KCND3 | voltage gated Potassium channel A-Type Shal Related member 3 | NM_172198 (Hs), NM_004980 (Hs), NM_019931 (Mm), NM_031739 (Rn) | 1969 | NP_004971 (Hs) (SEQ ID NO: 165), NP_751948 (Hs) (SEQ ID NO: 166), NP_064315 (Mm), NP_113927 (Rn) |
| Modifier KCNF1 | voltage gated Potassium channel modifier of Kv2 | NM_002236 (Hs), NM_201531 (Mm), NM_001169104 (Rn) | 1486 | NP_002227 (Hs) (SEQ ID NO: 167), NP_963289 (Mm), NP_001162575 (Rn) |
| Modifier KCNG1 | voltage gated Potassium channel modifier/silencer of Kv2 | NM_002237 (Hs), NM_001081134 (Mm), NM_001106545 (Rn) | 1546 | NP_002228 (Hs) (SEQ ID NO: 168), NP_001074603 (Mm), NP_001100015 (Rn) |
| Modifier KCNG2 | voltage gated Potassium channel modifier/silencer of Kv2 | NM_012283 (Hs), NM_012283.1 (Hs), XM_140499 (Mm), NM_001107372 (Rn) | 1403 | NP_036415.1 (Hs) (SEQ ID NO: 169), NP_036415 (Hs) (SEQ ID NO: 170), XP_140499 (Mm), NP_001100842 (Rn) |
| Modifier KCNG3 | voltage gated Potassium channel modifier/silencer of Kv2 | NM_133329 (Hs), NM_172344 (Hs), NM_153512 (Mm), NM_001033957 (Rn), NM_133426 (Rn) | 1315 | NP_579875 (Hs) (SEQ ID NO: 171), NP_758847 (Hs) (SEQ ID NO: 172), NP_705732 (Mm), NP_596917 (Rn), NP_001029129 (Rn) |
| Modifier KCNG4 | voltage gated Potassium channel modifier/silencer of Kv2 | NM_172347 (Hs), NM_025734 (Mm), NM_001107435 (Rn) | 1564 | NP_758857 (Hs) (SEQ ID NO: 173), NP_080010 (Mm), NP_001100905 (Rn) |
| KCNQ1 | voltage gated Potassium channel Delayed Rectifier KQT-Like member 1 | NM_000218 (Hs), NM_181798 (Hs), NM_008434 (Mm), NM_032073 (Rn) | 2032 | NP_000209 (Hs) (SEQ ID NO: 174), NP_032460 (Mm), NP_114462 (Rn) |
| KCNQ2 | voltage gated Potassium channel Delayed Rectifier KQT-Like member 2 | NM_172107 (Hs), NM_010611 (Mm), NM_133322 (Rn) | 2620 | NP_742105 (Hs) (SEQ ID NO: 175), NP_034741 (Mm), NP_579856 (Rn) |
| KCNQ3 | voltage gated Potassium channel Delayed Rectifier KQT-Like member 3 | NM_004519 (Hs), NM_152923 (Mm), NM_031597 (Rn) | 2620 | NP_004510 (Hs) (SEQ ID NO: 176), NP_690887 (Mm), NP_113785 (Rn) |
| KCNQ4 | voltage gated Potassium channel Delayed Rectifier KQT-Like member 4 | NM_172163.1 (Hs), NM_004700 (Hs), NM_001081142 (Mm), XM_233477 (Rn) | 2089 | NP_751895 (Hs) (SEQ ID NO: 177), NP_004691 (Hs) (SEQ ID NO: 178), NP_001074611 (Mm), XP_233477 (Rn) |
| KCNQ5 | voltage gated Potassium channel modifier/silencer of Kv2 | NM_019842 (Hs), NM_023872 (Mm), XM_001071249 (Rn) | 2803 | NP_062816 (Hs) (SEQ ID NO: 179), NP_076361 (Mm), XP_001071249 (Rn) |
| KCNV1 | voltage gated Potassium channel modifier/silencer of Kv2 | NM_014379 (Hs), NM_026200 (Mm), NM_021697 (Rn) | 1507 | NP_055194 (Hs) (SEQ ID NO: 180), NP_080476 (Mm), NP_067729 (Rn) |
| KCNV2 | voltage gated Potassium channel modifier/silencer of Kv2 | NM_133497 (Hs), NM_183179 (Mm), NM_001106370 (Rn) | 1642 | NP_598004 (Hs) (SEQ ID NO: 181), NP_899002 (Mm), NP_001099840 (Rn) |
| KCNS1 | voltage gated Potassium channel modifier/silencer of Kv2 | NM_002251 (Hs), NM_008435 (Mm), NM_053954 (Rn) | 1585 | NP_002242 (Hs) (SEQ ID NO: 182), NP_032461 (Mm), NP_446406 (Rn) |
| KCNS2 | voltage gated Potassium channel modifier/silencer of Kv2 | NM_020697 (Hs), NM_181317 (Mm), NM_023966 (Rn) | 1438 | NP_065748 (Hs) (SEQ ID NO: 183), NP_851834 (Mm), NP_076456 (Rn) |
| KCNS3 | voltage gated Potassium channel modifier/silencer of Kv2 | NM_002252 (Hs), NM_173417 (Mm), NM_031778 (Rn) | 1477 | NP_002243 (Hs) (SEQ ID NO: 184), NP_775593 (Mm), NP_113966 (Rn) |

TABLE 2-continued

| Gene | Complete name of the gene | Nucleotide Seq Ref (isoforms) | Amplified gene size (bp) | Protein Seq Ref (isoforms) and associated SEQ ID NOs |
|---|---|---|---|---|
| KCNH1 | voltage gated Potassium channel Delayed Rectifier Ether-A-Gogo (eag1) | NM_172362 (Hs), NM_010600 (Mm), NM_031742 (Rn) | 2974 | NP_758872 (Hs) (SEQ ID NO: 185), NP_034730 (Mm), NP_113930 (Rn) |
| KCNH5 | voltage gated Potassium channel Outward-Rectifying Ether-A-Gogo (eag2) | NM_172375 (Hs), NM_172376 (Hs), NM_139318 (Hs), NM_172805 (Mm), NM_133610 (Rn) | 2971 | NP_758963 (Hs) (SEQ ID NO: 186), NP_758964 (Hs) (SEQ ID NO: 187), NP_647479 (Hs), NP_766393 (Mm), NP_598294 (Rn) |
| KCNH2 | voltage gated Potassium channel Inwardly-Rectifying Ether-A-Gogo (erg1 or HERG) | NM_172056 (Hs), NM_000238 (Hs), NM_172057 (Hs), NM_013569 (Mm), NM_053949 (Rn) | 3484 | NP_000229 (Hs) (SEQ ID NO: 188), NP_742053 (Hs) (SEQ ID NO: 189), NP_742054 (Hs) (SEQ ID NO: 190), NP_038597 (Mm), NP_446401 (Rn) |
| KCNH6 | voltage gated Potassium channel Inwardly-Rectifying Ether-A-Gogo (erg2) | NM_030779 (Hs), NM_173092 (Hs), NM_001037712 (Mm), NM_053937 (Rn) | 2989 | NP_110406 (Hs) (SEQ ID NO: 191), NP_775115 (Hs) (SEQ ID NO: 192), NP_001032801 (Mm), NP_446389 (Rn) |
| KCNH7 | voltage gated Potassium channel Inwardly-Rectifying Ether-A-Gogo (erg3) | NM_173162 (Hs), NM_033272 (Hs), NM_133207 (Mm), NM_131912 (Rn) | 3595 | NP_775185 (Hs) (SEQ ID NO: 193), NP_150375 (Hs) (SEQ ID NO: 194), NP_573470 (Mm), NP_571987 (Rn) |
| KCNH8 | voltage gated Potassium channel Inwardly-Rectifying Ether-A-Gogo (elk1) | NM_144633 (Hs), NM_001031811 (Mm), NM_145095 (Rn) | 3328 | NP_653234 (Hs) (SEQ ID NO: 195), NP_001026981 (Mm), NP_659563 (Rn) |
| KCNH3 | voltage gated Potassium channel Inwardly-Rectifying Ether-A-Gogo (elk2) | NM_012284 (Hs), NM_010601 (Mm), NM_017108 (Rn) | 3259 | NP_036416 (Hs) (SEQ ID NO: 196), NP_034731 (Mm), NP_058804 (Rn) |
| KCNH4 | voltage gated Potassium channel Inwardly-Rectifying Ether-A-Gogo (elk1) | NM_012285 (Hs), NM_001081194 (Mm), NM_053630 (Rn) | 3058 | NP_036417 (Hs) (SEQ ID NO: 197), NP_001074663 (Mm), NP_446082 (Rn) |
| Intracellular calcium-activated potassium channels | | | | |
| KCNMA1 | large conductance calcium-activated Potassium channel Slo1 | NM_001014797 (Hs), NM_010610 (Mm), NM_031828 (Rn) | 3550 | NP_001014797 (Hs) (SEQ ID NO: 198), NP_034740 (Mm), NP_114016 (Rn) |
| KCNN1 | small conductance calcium-activated Potassium channel SK1 | NM_002248 (Hs), NM_032397 (Mm), NM_019313 (Rn) | 1636 | NP_002239 (Hs) (SEQ ID NO: 199), NP_115773 (Mm), NP_062186 (Rn) |
| KCNN2 | small conductance calcium-activated Potassium channel SK2 | NM_170775 (Hs), NM_021614 (Hs), NM_080465 (Mm), NM_019314 (Rn) | 1744 | NP_740721 (Hs) (SEQ ID NO: 200), NP_067627 (Hs) (SEQ ID NO: 201), NP_536713 (Mm), NP_062187 (Rn) |
| KCNN3 | small conductance calcium-activated Potassium channel SK3 | NM_002249 (Hs), NM_170782 (Hs), NM_080466 (Mm), NM_019315 (Rn) | 2197 | NP_740752 (Hs) (SEQ ID NO: 202), NP_002240 (Hs) (SEQ ID NO: 203), NP_536714 (Mm), NP_062188 (Rn) |
| KCNN4 | intermediate conductance calcium-activated Potassium channel SK4 | NM_002250 (Hs), NM_008433 (Mm), NM_023021 (Rn) | 1285 | NP_002241 (Hs) (SEQ ID NO: 204), NP_032459 (Mm), NP_075410 (Rn) |
| KCNT1 | sodium activated Potassium channel Slo2.2 (Slack) | NM_020822 (Hs), NM_175462 (Mm), NM_021853 (Rn) | 3775 | NP_065873 (Hs) (SEQ ID NO: 205), NP_780671 (Mm), NP_068625 (Rn) |
| KCNT2 | sodium activated Potassium channel Slo2.1 (Slick) | NM_198503 (Hs), NM_001081027 (Mm), NM_198762 (Rn) | 3409 | NP_940905 (Hs) (SEQ ID NO: 206), NP_001074496 (Mm), NP_942057 (Rn) |
| KCNU1 | sodium activated Potassium channel Slo3 | NM_001031836 (Hs), NM_008432 (Mm) | 3454 | NP_001027006 (Hs) (SEQ ID NO: 207), NP_032458 (Mm) |
| Inwardly rectifying potassium channels | | | | |
| KCNJ1 | Inwardly rectifying potassium channel Romk1 | NM_000220 (Hs), NM_153764 (Hs), NM_019659 (Mm), NM_017023 (Rn) | 1180 | NP_722448 (Hs) (SEQ ID NO: 208), NP_000211 (Hs) (SEQ ID NO: 209), NP_062633 (Mm), NP_058719 (Rn) |
| KCNJ2 | Inwardly rectifying potassium channel IRK1 | NM_000891 (Hs), NM_008425 (Mm), NM_017296 (Rn) | 1285 | NP_000882 (Hs) (SEQ ID NO: 210), NP_032451 (Mm), NP_058992 (Rn) |
| KCNJ12 | Inwardly rectifying potassium channel IRK2 | NM_021012 (Hs), NM_010603 (Mm), NM_053981 (Rn) | 1306 | NP_066292 (Hs) (SEQ ID NO: 211), NP_034733 (Mm), NP_446433 (Rn) |
| KCNJ4 | Inwardly rectifying potassium channel IRK3 | NM_152868 (Hs), NM_008427 (Mm), NM_053870 (Rn) | 1342 | NP_690607 (Hs) (SEQ ID NO: 212), NP_032453 (Mm), NP_446322 (Rn) |
| KCNJ14 | Inwardly rectifying potassium channel IRK4 | NM_170720 (Hs), NM_145963 (Mm), NM_170718 (Rn) | 1312 | NP_733838 (Hs) (SEQ ID NO: 213), NP_666075 (Mm), NP_733836 (Rn) |
| KCNJ3 | Inwardly rectifying potassium channel GIRK1 | NM_002239 (Hs), NM_008426 (Mm), NM_031610 (Rn) | 1510 | NP_002230 (Hs) (SEQ ID NO: 214), NP_032452 (Mm), NP_113798 (Rn) |
| KCNJ6 | Inwardly rectifying potassium channel GIRK2 | NM_002240 (Hs), NM_010606 (Mm), NM_001025590 (Mm), NM_001025585 (Mm), NM_001025584 (Mm), NM_013192 (Rn) | 1273 | NP_002231 (Hs) (SEQ ID NO: 215), NP_001020756 (Mm), NP_001020755 (Mm), NP_034736 (Mm), NP_001020761 (Mm), NP_037324 (Rn) |
| KCNJ9 | Inwardly rectifying potassium channel GIRK3 | NM_004983 (Hs), NM_008429 (Mm), NM_053834 (Rn) | 1186 | NP_004974 (Hs) (SEQ ID NO: 216), NP_032455 (Mm), NP_446286 (Rn) |
| KCNJ5 | Inwardly rectifying potassium channel GIRK4 | NM_000890 (Hs), NM_010605 (Mm), NM_017297 (Rn) | 1264 | NP_000881 (Hs) (SEQ ID NO: 217), NP_034735 (Mm), NP_058993 (Rn) |

TABLE 2-continued

| Gene | Complete name of the gene | Nucleotide Seq Ref (isoforms) | Amplified gene size (bp) | Protein Seq Ref (isoforms) and associated SEQ ID NOs |
|---|---|---|---|---|
| KCNJ10 | Inwardly rectifying potassium channel BIR10 | NM_002241 (Hs), NM_001039484 (Mm), NM_031602 (Rn) | 1144 | NP_002232 (Hs) (SEQ ID NO: 218), NP_001034573 (Mm), NP_113790 (Rn) |
| KCNJ15 | Inwardly rectifying potassium channel IRKK (Kir1.3) | NM_170736 (Hs), NM_001039057 (Mm), NM_001039056 (Mm), NM_133321 (Rn) | 1129 | NP_733932 (Hs) (SEQ ID NO: 219), NP_001034145 (Mm), NP_001034146 (Mm), NP_579855 (Rn) |
| KCNJ16 | Inwardly rectifying potassium channel BIR9 | NM_018658 (Hs), NM_010604 (Mm), NM_053314 (Rn) | 1261 | NP_061128 (Hs) (SEQ ID NO: 220), NP_034734 (Mm), NP_445766 (Rn) |
| KCNJ8 | ATP-sensitive potassium channel K-ATP1 | NM_004982 (Hs), NM_008428 (Mm), NM_017099 (Rn) | 1279 | NP_004973 (Hs) (SEQ ID NO: 221), NP_032454 (Mm), NP_058795 (Rn) |
| KCNJ11 | ATP-sensitive potassium channel BIR | NM_000525 (Hs), NM_010602 (Mm), NM_031358 (Rn) | 1177 | NP_000516 (Hs) (SEQ ID NO: 222), NP_034732 (Mm), NP_112648 (Rn) |
| KCNJ13 | ATP-sensitive potassium channel (Kir1.4) | NM_002242 (Hs), NM_053608 (Rn) | 1084 | NP_002233 (Hs) (SEQ ID NO: 223), NP_446060 (Rn) |
| 2-P-domain potassium channels | | | | |
| KCNK1 | two pore domain potassium channel TWIK1 | NM_002245 (Hs), NM_008430 (Mm), NM_021688 (Rn) | 1008 | NP_002236 (Hs) (SEQ ID NO: 224), NP_032456 (Mm), NP_067720 (Rn) |
| KCNK2 | two pore domain potassium channel TREK1 | NM_001017424 (Hs), NM_010607 (Mm), NM_172042 (Rn) | 1278 | NP_001017424 (Hs) (SEQ ID NO: 225), NP_034737 (Mm), NP_742038 (Rn) |
| KCNK3 | two pore domain potassium channel TASK1 | NM_002246 (Hs), NM_010608 (Mm), NM_033376 (Rn) | 1182 | NP_002237 (Hs) (SEQ ID NO: 226), NP_034738 (Mm), NP_203694 (Rn) |
| KCNK4 | two pore domain potassium channel TRAAK | NM_033310 (Hs), NM_008431 (Mm), NM_053804 (Rn) | 1179 | NP_201567 (Hs) (SEQ ID NO: 227), NP_032457 (Mm), NP_446256 (Rn) |
| KCNK5 | two pore domain potassium channel TASK2 | NM_003740 (Hs), NM_021542 (Mm), NM_001039516 (Rn) | 1497 | NP_003731 (Hs) (SEQ ID NO: 228), NP_067517 (Mm), NP_001034605 (Rn) |
| KCNK6 | two pore domain potassium channel TWIK2 | NM_004823 (Hs), NM_001033525 (Mm), NM_053806 (Rn) | 939 | NP_004814 (Hs) (SEQ ID NO: 229), NP_001028697 (Mm), NP_446258 (Rn) |
| KCNK7 | two pore domain potassium channel member 7 | NM_033347 (Hs), NM_010609 (Mm) | 921 | NP_203133 (Hs) (SEQ ID NO: 230), NP_034739 (Mm) |
| KCNK9 | two pore domain potassium channel TASK3 | NM_016601 (Hs), NM_001033876 (Mm), NM_053405 (Rn) | 1122 | NP_057685 (Hs) (SEQ ID NO: 231), NP_001029048 (Mm), NP_445857 (Rn) |
| KCNK10 | two pore domain potassium channel TREK2 | NM_021161 (Hs), NM_029911 (Mm), NM_023096 (Rn) | 1614 | NP_066984 (Hs) (SEQ ID NO: 232), NP_084187 (Mm), NP_075584 (Rn) |
| KCNK12 | two pore domain potassium channel THIK2 | NM_022055 (Hs), NM_199251 (Mm), NM_022292 (Rn) | 1290 | NP_071338 (Hs) (SEQ ID NO: 233), NP_954859 (Mm), NP_071628 (Rn) |
| KCNK13 | two pore domain potassium channel THIK1 | NM_022054 (Hs), NM_146037 (Mm), NM_022293 (Rn) | 1224 | NP_071337 (Hs) (SEQ ID NO: 234), NP_666149 (Mm), NP_071629 (Rn) |
| KCNK15 | two pore domain potassium channel TASK5 | NM_022358 (Hs), NM_001030292 (Mm), NM_130813 (Rn) | 990 | NP_071753 (Hs) (SEQ ID NO: 235), NP_001025463 (Mm), NP_570826 (Rn) |
| KCNK16 | two pore domain potassium channel TALK1 | NM_032115 (Hs), NM_029006 (Mm) | 930 | NP_115491 (Hs) (SEQ ID NO: 236), NP_083282 (Mm) |
| KCNK17 | two pore domain potassium channel TASK4-TALK2 | NM_031460 (Hs) | 996 | NP_113648 (Hs) (SEQ ID NO: 237) |
| KCNK18 | two pore domain potassium channel TRESK1/TRESK2 | NM_181840 (Hs), NM_207261 (Mm), NM_001003820 (Rn) | 1152 | NP_862823 (Hs) (SEQ ID NO: 238), NP_997144 (Mm), NP_001003820 (Rn) |
| Nucleotide-activated ion channels | | | | |
| CNGA1 | Cyclic nucleotide gated cation channel Alpha 1 | NM_000087 (Hs), NM_007723 (Mm), NM_053497 (Rn) | 2073 | NP_000078 (Hs) (SEQ ID NO: 239), NP_031749 (Mm), NP_445949 (Rn) |
| CNGA2 | Cyclic nucleotide gated cation channel Alpha 2 | NM_005140 (Hs), NM_007724 (Mm), NM_012928 (Rn) | 1995 | NP_005131 (Hs) (SEQ ID NO: 240), NP_031750 (Mm), NP_037060 (Rn) |
| CNGA3 | Cyclic nucleotide gated cation channel Alpha 3 | NM_001298 (Hs), NM_009918 (Mm), NM_053495 (Rn) | 2086 | NP_001073347 (Hs) (SEQ ID NO: 241), NP_034048 (Mm), NP_445947 (Rn) |
| CNGA4 | Cyclic nucleotide gated cation channel Alpha 4 | NM_001037329 (Hs), NM_001033317 (Mm), NM_053496 (Rn) | 1731 | NP_001032406 (Hs) (SEQ ID NO: 242), NP_001028489 (Mm), NP_445948 (Rn) |
| CNGB1 | Cyclic nucleotide gated cation channel Beta1 | NM_001297 (Hs), NM_031809 (Rn) | 3763 | NP_001288 (Hs) (SEQ ID NO: 243), XP_001476248 (Mm), NP_113997 (Rn) |
| CNGB3 | Cyclic nucleotide gated cation channel Beta3 | NM_019098 (Hs), NM_013927 (Mm) | 2434 | NP_061971 (Hs) (SEQ ID NO: 244), NP_038955 (Mm) |
| HCN1 | hyperpolarization Cyclic nucleotide gated cation channel member 1 | NM_021072 (Hs), NM_010408 (Mm), NM_053375 (Rn) | 2674 | NP_066550 (Hs) (SEQ ID NO: 245), NP_034538 (Mm), NP_445827 (Rn) |
| HCN2 | hyperpolarization Cyclic nucleotide gated cation channel member 2 | NM_001194 (Hs), NM_008226 (Mm), NM_053684 (Rn) | 2671 | NP_001185 (Hs) (SEQ ID NO: 246), NP_032252 (Mm), NP_446136 (Rn) |

TABLE 2-continued

| Gene | Complete name of the gene | Nucleotide Seq Ref (isoforms) | Amplified gene size (bp) | Protein Seq Ref (isoforms) and associated SEQ ID NOs |
|---|---|---|---|---|
| HCN3 | hyperpolarization Cyclic nucleotide gated cation channel member 3 | NM_020897 (Hs), NM_008227 (Mm), NM_053685 (Rn) | 2326 | NP_065948 (Hs) (SEQ ID NO: 247), NP_032253 (Mm), NP_446137 (Rn) |
| HCN4 | hyperpolarization Cyclic nucleotide gated cation channel member 4 | NM_005477 (Hs), NM_001081192 (Mm), NM_021658 (Rn) | 3613 | NP_005468 (Hs) (SEQ ID NO: 248), NP_001074661 (Mm), NP_067690 (Rn) |
| TRP channels | | | | |
| TRPC1 | transient receptor potential (TRP) non selective cation channel C member 1 | NM_003304 (Hs), NM_011643 (Mm), NM_053558 (Rn) | 2284 | NP_003295 (Hs) (SEQ ID NO: 249), NP_035773 (Mm), NP_446010 (Rn) |
| TRPC3 | diacyglycerol (DAG) Ca2+ activated TRP channel C | NM_003305 (Hs), NM_019510 (Mm), NM_021771 (Rn) | 2548 | NP_003296 (Hs) (SEQ ID NO: 250), NP_062383 (Mm), NP_068539 (Rn) |
| TRPC4 | TRP receptor operated channel | NM_016179 (Hs), NM_016984 (Mm), NM_080396 (Rn), NM_001083115 (Rn) | 2935 | NP_057263 (Hs) (SEQ ID NO: 251), NP_058680 (Mm), NP_001076584 (Rn), NP_536321 (Rn) |
| TRPC5 | TRP receptor operated channel | NM_012471 (Hs), NM_009428 (Mm), NM_080898 (Rn) | 2923 | NP_036603 (Hs) (SEQ ID NO: 252), NP_033454 (Mm), NP_543174 (Rn) |
| TRPC6 | DAG activated TRP channel | NM_004621 (Hs), NM_013838 (Mm), NM_053559 (Rn) | 2800 | NP_004612 (Hs) (SEQ ID NO: 253), NP_038866 (Mm), NP_446011 (Rn) |
| TRPC7 | Cardiac TRP channel | NM_020389 (Hs), NM_012035 (Mm), XM_225159 (Rn) | 2593 | NP_065122 (Hs) (SEQ ID NO: 254), NP_036165 (Mm), XP_001067646 (Rn) |
| TRPV1 | Vanilloid (capsaicin) receptor and noxious thermosensor channel | NM_018727 (Hs), NM_001001445 (Mm), NM_031982 (Rn) | 2524 | NP_061197 (Hs) (SEQ ID NO: 255), NP_001001445 (Mm), NP_114188 (Rn) |
| TRPV2 | noxious heat thermosensor channel | NM_016113 (Hs), NM_011706 (Mm), NM_017207 (Rn) | 2299 | NP_057197 (Hs) (SEQ ID NO: 256), NP_035836 (Mm), NP_58903 (Rn) |
| TRPV3 | warmth sensor channel | NM_145068 (Hs), NM_145099 (Mm), NM_001025757 (Rn) | 2380 | NP_659505 (Hs) (SEQ ID NO: 257), NP_659567 (Mm), NP_001020928 (Rn) |
| TRPV4 | Osmosensor channel | NM_021625 (Hs), NM_022017 (Mm), NM_023970 (Rn) | 2620 | NP_067638 (Hs) (SEQ ID NO: 258), NP_071300 (Mm), NP_76460 (Rn) |
| TRPM1 | putative melastatin TRP channel | NM_002420 (Hs), NM_018752 (Mm), NM_001037734 (Rn) | 4816 | NP_002411 (Hs) (SEQ ID NO: 259), NP_061222 (Mm), NP_001032823 (Rn) |
| TRPM2 | nucleotide sensing TRP channel | NM_003307 (Hs), NM_138301 (Mm), NM_001011559 (Rn) | 4513 | NP_003298 (Hs) (SEQ ID NO: 260), NP_612174 (Mm), NP_001011559 (Rn) |
| TRPM3 | Melastatin related TRP channel | NM_020952 (Hs), NM_001035239 (Mm), XM_219902 (Rn) | 4669 | NP_066003 (Hs) (SEQ ID NO: 261), NP_001030319 (Mm), XP_219902 (Rn) |
| TRPM4 | Ca2+ activated Na+ TRP channel | NM_017636 (Hs), NM_175130 (Mm), NM_001136229 (Rn) | 3646 | NP_060106 (Hs) (SEQ ID NO: 262), NP_780339 (Mm), NP_001129701 (Rn) |
| TRPM5 | Nonselective, monovalent cation TRP channel | NM_014555 (Hs), NM_020277 (Mm), XM_344979 (Rn) | 3502 | NP_055370 (Hs) (SEQ ID NO: 263), NP_064673 (Mm), XP_344980 (Rn) |
| TRPM6 | Channel kinase TRP channel | NM_017662 (Hs), NM_153417 (Mm), XM_219747 (Rn) | 6073 | NP_060132 (Hs) (SEQ ID NO: 264), NP_700466 (Mm), XP_219747 (Rn) |
| TRPM7 | Kinase TRP channel | NM_017672 (Hs), NM_021450 (Mm), XM_001056331 (Rn) | 5602 | NP_060142 (Hs) (SEQ ID NO: 265), NP_067425 (Mm), XP_001056331 (Rn) |
| TRPM8 | Cooling and menthol-sensing TRP channel | NM_024080 (Hs), NM_134252 (Mm), NM_134371 (Rn) | 3319 | NP_076985 (Hs) (SEQ ID NO: 266), NP_599013 (Mm), NP_599198 (Rn) |
| TRPA1 | Nonselective cation TRP channel | NM_007332 (Hs), NM_177781 (Mm), NM_207608 (Rn) | 3364 | NP_015628 (Hs) (SEQ ID NO: 267), NP_808449 (Mm), NP_997491 (Rn) |
| TRPP1 | Nonselective cation TRP channel PKD2 | NM_000297 (Hs), NM_008861 (Mm), XM_573552 (Rn) | 2908 | NP_000288 (Hs) (SEQ ID NO: 268), NP_032887 (Mm), XP_573552 (Rn) |
| TRPP2 | Nonselective cation TRP channel PKD2L1 | NM_016112 (Hs), NM_181422 (Mm), NM_001106352 (Rn) | 2422 | NP_057196 (Hs) (SEQ ID NO: 269), NP_852087 (Mm), NP_001099822 (Rn) |
| TRPP3 | Nonselective cation TRP channel PKD2L2 | NM_014386 (Hs), NM_016927 (Mm), NM_001106156 (Rn) | 1843 | NP_055201 (Hs) (SEQ ID NO: 270), NP_058623 (Mm), NP_001099626 (Rn) |
| TRPML1 | Nonselective cation TRP channel | NM_020533 (Hs), NM_053177 (Mm), NM_001105903 (Rn) | 1747 | NP_065394 (Hs) (SEQ ID NO: 271), NP_444407 (Mm), NP_001099373 (Rn) |
| TRPML2 | Nonselective cation TRP channel | NM_153259 (Hs), NM_001005846 (Mm), NM_026656 (Mm), NM_001039005 (Rn) | 1702 | NP_694991 (Hs) (SEQ ID NO: 272), NP_001005846 (Mm), NP_080932 (Mm), NP_001034094 (Rn) |
| TRPML3 | Nonselective cation TRP channel | NM_018298 (Hs), NM_134160 (Mm), NM_001012059 (Rn) | 1663 | NP_060768 (Hs) (SEQ ID NO: 273), NP_598921 (Mm), NP_001012059 (Rn) |

TABLE 2-continued

| Gene | Complete name of the gene | Nucleotide Seq Ref (isoforms) | Amplified gene size (bp) | Protein Seq Ref (isoforms) and associated SEQ ID NOs |
|---|---|---|---|---|
| | | Chloride channels | | |
| CLC1 | chloride channel 1 | NM_000083.2 | 2968 | NP_000074.2 (SEQ ID NO: 274) |
| CLC2 | chloride channel 2 | NM_004366.4 | 2698 | NP_004357.3 (SEQ ID NO: 275) |
| CLC3 | chloride channel 3 | NM_173872.3 | 2602 | NP_776297.2 (SEQ ID NO: 276) |
| CLC4 | chloride channel 4 | NP_001821.2 | 2284 | NP_001821.2 (SEQ ID NO: 277) |
| CLC5 | chloride channel 5 | NM_000084.2 | 2242 | NP_000075.1 (SEQ ID NO: 278) |
| CLC6 | chloride channel 6 | NM_001286.2 | 2611 | NP_001277.1 (SEQ ID NO: 279) |
| CLC7 | chloride channel 7 | NM_001287.4 | 2419 | NP_001278.1 (SEQ ID NO: 280) |
| | | Acid-sensitive cation channels | | |
| ACCN1 | amiloride-sensitive cation channel 1 | NM_183377.1 | 1696 | NP_899233.1 (SEQ ID NO: 281) |
| ACCN2 | amiloride-sensitive cation channel 2 | NM_020039.2 | 1726 | NP_064423.2 (SEQ ID NO: 282) |
| ACCN3 | amiloride-sensitive cation channel 3 | NM_020322.2 | 1600 | NP_064718.1 (SEQ ID NO: 283) |
| ACCN4 | amiloride-sensitive cation channel 4 | NM_018674.4 | 2005 | NP_061144.3 (SEQ ID NO: 284) |
| | | Sodium channel auxiliary subunits | | |
| SCN1B | voltage gated sodium channel type I b subunit | NM_001037.4 | 658 | NP_001028.1 (SEQ ID NO: 285) |
| SCN2B | voltage gated sodium channel type 2 b subunit | NM_004588.4 | 652 | NP_004579.1 (SEQ ID NO: 286) |
| SCN3B | voltage gated sodium channel type 3 b subunit | NM_018400.3 | 652 | NP_060870.1 (SEQ ID NO: 287) |
| SCN4B | voltage gated sodium channel type 4 b subunit | NM_174934.3 | 694 | NP_777594.1 (SEQ ID NO: 288) |
| | | Calcium channel auxiliary subunits | | |
| CACNB1 | voltage gated calcium channel b1 subunit | NM_000723.4 | 1798 | NP_000714.3 (SEQ ID NO: 289) |
| CACNB2 | voltage gated calcium channel b2 subunit | NM_000724.3 | 1822 | NP_000715.2 (SEQ ID NO: 290) |
| CACNB3 | voltage gated calcium channel b3 subunit | NM_000725.3 | 1459 | NP_000716.2 (SEQ ID NO: 291) |
| CACNB4 | voltage gated calcium channel b4 subunit | NM_000726.3 | 1465 | NP_000717.2 (SEQ ID NO: 292) |
| CACNA2 | voltage gated calcium channel a2d subunit | NM_000722.2 (HS), NM_001110843.1 (Mm) NM_012919 (RN) | 3277 | NP_000713.2 (HS) (SEQ ID NO: 293), NP_001104313.1 (Mm), NP_037051 (RN) |
| CACNG2 | voltage gated calcium channel g subunit | NM_006078.3 (HS), NM_007583.2 (Mm) | 973 | NP_006069.1 (HS) (SEQ ID NO: 294), NP_031609.1 (Mm) |
| | | OTHERS | | |
| ABCC8 | ATP-binding cassette, sub-family C SUR1 | NM_000352.3 (HS) NM_011510.3 (Mm) | | NP_000343.2 (HS) (SEQ ID NO: 295), NP_035640.2 (Mm) |
| ABCC9 | SUR2 | NM_020297.2 | | NP_064693.2 (SEQ ID NO: 296) |
| LGi1 | LGi1 | NM_005097.2 | | NP_005088.1 (SEQ ID NO: 297) |
| CNTNAP2 | CASPR2 | NM_014141.5 | | NP_054860.1 (SEQ ID NO: 298) |
| KCNAB1 | Kv b1 | NM_172160.2 | | NP_751892.1 (SEQ ID NO: 299) |
| KCNAB2 | Kv b2 | NM_003636.3 | | NP_003627.1 (SEQ ID NO: 300) |
| KCNAB3 | Kv b3 | NM_004732.2 | | NP_004723.2 (SEQ ID NO: 301) |
| KCNMB1 | BK b1 | NM_004137.2 | | NP_004128.1 (SEQ ID NO: 302) |
| KCNMB2 | BK b2 | NM_005832.3 | | NP_005823.1 (SEQ ID NO: 303) |
| KCNMB3 | BK b3 | NM_171828.1 | | NP_741979.1 (SEQ ID NO: 304) |
| KCNMB4 | BK b4 | NM_014505.5 | | NP_055320.4 (SEQ ID NO: 305) |
| AQP1 | AQP1 | NM_198098.2 | | NP_932766.1 (SEQ ID NO: 306) |
| AQP2 | AQP2 | NM_000486.5 | | NP_000477.1 (SEQ ID NO: 307) |
| AQP3 | AQP3 | NM_004925.4 | | NP_004916.1 (SEQ ID NO: 308) |
| AQP4 | AQP4 | NM_001650.4 | | NP_001641.1 (SEQ ID NO: 309) |
| GJB1 | Connexin 32 | NM_000166.5, NM_000165.3 | | NP_000157.1 (SEQ ID NO: 310) |
| GJA1 | Connexin 43 | NM_000165.3 | | NP_000156.1 (SEQ ID NO: 311) |

Hs: *Homo sapiens* (human)
Mm: *Mus musculus* (mouse)
Rn: *Rattus norvegicus* (rat)

In one particular embodiment of the invention, the membrane protein of interest is chosen from a GABA receptor, typically a $GABA_B$ ($GABA_BR1$ or $GABA_BR2$, for example) receptor; a glutamate receptor, typically an alpha-amino-3-hydroxy-5-methylisoazole-4-propionic acid (AMPA) receptor, preferably the GluR3 subunit of the glutamate receptor (SEQ ID NO: 73 or SEQ ID NO: 74) or an N-methyl-D-aspartate (NMDA)-activated glutamate receptor, preferably the NMDAR1 subunit of the human glutamate receptor (SEQ ID NO: 62); aquaporin 2 (SEQ ID NO: 307); aquaporin 4 (SEQ ID NO: 309); a potassium channel; a calcium channel; an acetylcholine receptor, preferably the α3 subunit (SEQ ID NO: 9) of the human nicotinic acetylcholine receptor (ACHα3); a protein associated with voltage gated potassium channels, preferably CASPR2 (SEQ ID NO: 298) or LGI1 (SEQ ID NO: 297); a glycine receptor; connexin 32 (SEQ ID NO: 310); and connexin 43 (SEQ ID NO: 311).

Another subject of the invention relates to a chip comprising at least 20 different proteins of interest, for example at least 50, typically at least 100 different proteins of interest, preferably between approximately 20 and approximately 400 different proteins of interest, for example, approximately 250 or approximately 300 different proteins of interest, or between approximately 20 and approximately 100 different proteins of interest, for example, approximately 50 different proteins of interest, each protein of interest being optionally associated with one or more auxiliary subunits. These proteins of interest are preferably membrane proteins chosen from the proteins of which the sequences (preferably the sequences of the human proteins) are identified in Table 2.

The inventors have in particular developed chips comprising membrane proteins corresponding to proteins, such as ion channel proteins, transporter proteins and/or membrane receptor proteins which regulate the activity of an ion channel protein or of a transporter protein. These proteins are encoded by the sequences, preferably the sequences identified by a SEQ ID number, even more preferably by the human sequences identified by a SEQ ID number referenced in Table 2.

In order to fabricate these chips, the inventors have, without a priori, amplified by PCR a large number of subunits obtained from human brain cDNA (see Examples section). The products have been subcloned into an expression vector and transfected into cells in culture in multiwell plates, each well containing cells expressing a single type of membrane protein or membrane protein complex. The same tag sequence introduced into each channel makes it possible, in accordance with the knowledge of those skilled in the art, to measure and standardize the expression level of the proteins or protein complexes. The proteins and protein complexes of these cells are solubilized in a buffer containing a non-denaturing detergent. This solubilisate is then typically deposited in the form of a spot on a support, preferably a solid support, for example, on a solid membrane. Typically, various amounts of solubilisate, and also preferably one or more negative and positive controls, are deposited on the same support in order to verify the specificity of the signals obtained. The reading of the chip (detection of the antigen/antibody (Ag/Ab) complexes) can be carried out by immunofluorescence, immunoluminescence, or colorimetry by means of one of the techniques known to those skilled in the art.

Thus, a particular subject of the invention relates to a chip as described in the present text, said protein(s) of interest of which is (are) labelled with the same peptide sequence (tag), recognized by one or more detection antibodies known to those skilled in the art, such as the V5 antibody, which recognizes the GKPIPNPLLGLDST sequence (SEQ ID NO: 312). Other tags that can be used in the context of the present invention are, for example, the T7 Flag, Ha, myc and His (hexahistidine) tags.

In one preferred embodiment, the protein chip according to the invention comprises at least one positive control and/or one negative control, typically one positive control and one negative control, in order to verify the specificity of the signals obtained. The negative control typically consists of a cell extract not comprising the protein of interest. The positive control typically consists of human immunoglobulins, for example, IgGs, and makes it possible to validate the ability of the protein chip according to the invention to detect the presence of autoantibodies capable of binding to the proteins of interest in a biological sample to be tested.

The chips used in the context of the invention comprise a support capable of binding solubilized proteins, typically a solid (or semi-solid) support, preferably chosen from a membrane, typically a nitrocellulose or nylon membrane, glass, and a polymer capable of absorbing immune complexes, typically plastic (for example PVDF).

Such a support can be treated, in order to improve its cell extract-binding properties, using products and according to methods known to those skilled in the art. The support can, for example, be coated with a layer of organosilicon compounds (silane) and/or be functionalized with glycosaminoglycans (GAGs).

Another subject of the invention relates, moreover, to a kit comprising a chip as described previously, and, optionally, one or more reagents preferably chosen from a buffer for blocking the non-specific sites, a buffer allowing the association between antibodies and antigens (Ab/Ag), a washing buffer, one or more secondary antibodies, one or more product(s) for detecting said secondary antibody or antibodies, a standard solution for preparing a calibration curve, and instructions for use, typically instructions for use of one, several or all of said elements of the kit.

Such a kit may typically be used in the screening for new targets of interest, for example targets involved in the occurrence of an autoimmune disease, in particular of a disease affecting the nervous system of a mammal, or in the diagnosis or the monitoring of the progression of such an autoimmune disease in a patient receiving treatment in order to determine, in this patient, the efficacy of said treatment.

One particular subject of the invention thus relates to a kit for screening for targets of interest involved in the occurrence of a disease of interest, for example, of an autoimmune disease.

Another particular subject of the invention relates, moreover, to a kit for diagnosing a disease, typically an autoimmune disease as described previously, in an animal, typically a mammal, preferably a human being.

Preparation of the Chip

Another subject of the invention relates to a method for preparing a chip as described previously, comprising the following steps a) of cloning the cDNA(s) of interest; b) of expressing the protein(s), typically the membrane protein(s), encoded by said cDNA(s) in a protein-producing system, typically in cells in culture; c) of solubilizing the proteins expressed using a non-denaturing detergent, typically a non-ionic detergent (also identified as "mild detergent"), which enables the solubilization of said proteins while at the same time preserving their conformation (three-dimensional structure) and their ability to bind to a support; and d) of depositing said solubilized proteins on a support in order to obtain the chip of interest.

The invention also relates to a chip capable of being obtained by means of a method according to the invention as described previously.

Preferably, the chip according to the invention allows the detection, by those skilled in the art, of the proteins of interest which have bound to the support, by means of a conventional detection method, typically involving a single detection antibody. Such a chip allows its fabricator or its user to be sure that the protein(s) of interest is correctly expressed on said chip.

A means for obtaining such a chip consists of cloning the protein of interest (step a) of the method described previously) using an expression vector which allows i) the insertion of a tag, as described previously, in the same reading frame as the sequence encoding the protein of interest, and ii) the expression of a protein fused, preferably in the C-terminal position, to said tag. Such a tag makes it possible to verify and to measure the expression of the protein of interest associated with said tag.

The expression vector used is preferably a directional vector which allows the insertion of the gene of interest following PCR amplification thereof, without a prior enzymatic digestion step. An example of a directional vector is provided in the Examples section of the present application which uses the pcDNA6.2/V5/GW/D-TOPO vector (Invitrogen).

Advantageously, the vector used also benefits from the Gateway technology which makes it possible to envisage the rapid transfer of the gene encoding the protein of interest from a first vector to a second vector benefiting from the same technology but having different expression properties (the gene being cloned into the donor vector between two recombination sites compatible with all the Gateway recipient vectors). This technology makes it possible, for example, to transfer the gene encoding the protein of interest from a vector (donor vector) which allows expression in mammalian cells to a vector (recipient vector) which allows expression in insect cells, batrachian cells, yeast or bacteria, or else to a vector that is identical but has no tag. A vector benefiting from the Gateway technology can be chosen, for example, from the vectors pT-REx™-DEST30 (allowing expression in mammalian cells), pET™-DEST42 (allowing expression in bacteria), pDEST™8 (allowing expression in insect cells) and pYES2-DEST52 (allowing expression in yeasts).

During the PCR amplification of the genes, the forward primer preferably begins with the sequence CACC (SEQ ID NO: 313) (which precedes the start codon (ATG) of the gene of interest). In another preferred embodiment, a guanidine (G) nucleotide is inserted after the ATG start codon in order to obtain a Kozak sequence. In yet another embodiment, an additional GGA codon is introduced into the nucleotide sequence following the start codon of the gene of interest.

According to yet another preferred embodiment, the reverse primer does not contain a stop codon and/or does not end with the sequence complementary to the beginning of the forward primer.

Preferentially, the (forward and/or reverse) primers have a hybridization temperature of between approximately 70° C. and approximately 80° C., and also advantageously a percentage of GC units of less than approximately 60%.

Step b) of expressing the protein(s) encoded by said cDNA(s) of interest is advantageously carried out in cells in culture, preferably in human cells. The cells are generally placed in culture on multiwell plates, optionally treated to promote the adhesion of the cells using the techniques known to those skilled in the art, each well preferably containing cells expressing a single type of protein of interest. The expression of the protein of interest can be controlled as early as this stage, and, if required, standardized, through the possible detection (for example, by immunofluorescence) of the tag sequence that is expressed, where appropriate at the same time as the protein of interest. The cells selected are preferably cells exhibiting the satisfactory properties of adhesion to the culture support, which are simple to culture and to manipulate. Such cells can be advantageously selected, for example, from the HEK293A, COS, MDCK, CHO and CCL39 lines.

The method according to the invention comprises, moreover, a step c) of solubilizing the protein(s) of interest using a detergent, preferably using a non-denaturing detergent capable of preserving the conformation of the native protein and also its ability to bind to a support, typically to a support as described previously, preferably to a solid support of membrane type. The inventors have discovered that the detergent can be advantageously selected from Triton X-100, Triton X-114, Nonidet P-40, CHAPS, sodium cholate, sodium deoxycholate, digitonin, sarkosyl NL30 and octylglucoside.

Finally, the method comprises a step d) of depositing solubilized proteins of interest onto a support as described previously, in order to obtain the chip according to the invention. This step is typically carried out by depositing, in the form of spots, the solubilisates obtained at the end of step c) onto the chosen support, by means of techniques known to those skilled in the art.

Uses

There is, in particular, at the current time no tool for simply and effectively detecting the presence of autoantibodies directed against membrane proteins and/or membrane protein complexes in a biological sample, without having to visualize by microscopy the antigen/antibody (Ag/Ab) complexes formed at the surface of cells (previously transfected with the sequence encoding the antigen of interest) or of tissue sections. The chip according to the invention is thus the first available tool which allows the detection of Ag protein complexes or membrane protein/Ab complexes directly on a solid support (test on membrane, for example).

The chip according to the invention can be advantageously used in the context of a method for the diagnosis and/or for the monitoring of the progression of a disease, typically of an autoimmune disease as described previously, preferably of an encephalopathy associated with neuronal excitability disorders, linked to the expression of one or more of the proteins, in particular membrane proteins, of interest bound to the support of said chip, or else in the context of a method for determining the efficacy of a treatment applied to a given patient. The immediate or gradual disappearance of the autoantibodies sought in the biological sample originating from a patient receiving therapeutic treatment, evaluated using the protein chip according to the invention, thus makes it possible to verify, over time, the efficacy of the treatment applied to said patient. The absence of an effect of said treatment, readily detectable using said chip, makes it possible, moreover, to then correct or adapt, at an early stage, the treatment applied to a given patient.

The chip according to the invention may also be used in the context of methods required for searching for and identifying (screening methods) antibodies of interest, even present at very low concentrations (i.e., about one millimole), in particular autoantibodies, and also new antigen targets of diseases, for example, of autoimmune diseases (antigens of interest involved in the occurrence of an immune disease).

The biological samples from subjects identified as suffering from pathological conditions suspected of belonging or clearly identified as belonging to the autoimmune disease category can advantageously be used for this purpose.

It is thus now possible to produce and use a chip according to the invention (typically a chip which has i) all of the proteins, in particular of the proteins or membrane protein complexes, expressed by a given tissue, ii) all of the proteins, in particular of the proteins or membrane protein complexes, involved in a particular physiological mechanism, or iii) all of the proteins, in particular of the proteins or membrane protein complexes, involved in a specific metabolic pathway) in order to detect new autoantibodies or to identify new targets of therapeutic interest.

The large-scale screening permitted by this new tool allows the simultaneous detection of a very large number of Ag/Ab complexes. It also allows archiving of results which is simpler than that permitted by the currently known tests used on cells or tissue sections. The membranes represent surface areas of approximately 4 cm by 4 cm with the thickness of a sheet of paper. They are detected on a "photo" of identical size which can be stored like any paper or digital photo. In the case of tissue sections or transfected cells, the slides are archived in a freezer.

The facilitated identification of antibodies, for example of autoantibodies involved in autoimmune pathological conditions of the nervous system, and of their targets, using a chip according to the invention offering sufficient sensitivity, presently allows the development of diagnostic tests, in particular of serological tests, which are more efficient, simpler and less expensive.

The protein chip according to the invention, by virtue of the new antigen/antibody complexes that it makes it possible to identify, allows, moreover, the development of new therapeutic treatments involving the use of the antibodies identified, or of modulators of the formation of said antigen/antibody complexes, as medicaments, or in the context of the preparation of pharmaceutical compositions of interest.

The following figures and examples illustrate the invention by describing the obtaining of chips in accordance with the invention and by providing examples of uses of said chips, without limiting the scope thereof.

FIGURE LEGENDS

FIGS. 1A-1B: Validation of the efficiency of the protein chip by virtue of a test carried out on the samples originating from 43 patients.

A. Plan of a plate representing quadruplicates of a nitrocellulose membrane onto which are deposited, for each of the quadruplicates, decreasing concentrations of an extract of solubilized membranes of cells having overexpressed the NR1 receptor, an extract of solubilized membranes of cells without vector, and a $\frac{1}{200}^{th}$ dilution of human serum.

B. Photos of supports corresponding, respectively, to i) an expression control using the V5 tag alone, ii) an expression control using a sample originating from a positive patient, iii) an example of a negative sample, and iv) an example of a positive sample.

Of the 43 samples tested, 15 samples out of 17 positive samples were detected using the protein chip, i.e., a protein chip specificity of 88%. 100% of the negative samples were, moreover, detected.

FIGS. 2A-2F: Example of use of a protein chip according to the invention comprising 40 proteins of interest.

A. Plate 1: it contains two wells containing human IgGs and 22 wells containing the solubilized proteins of HEK cell membranes, each cell expressing a different membrane protein chosen from the proteins identified in Table 2 (referenced SEQ ID NO: 1 to SEQ ID NO: 311).

B. Plate 2: it contains two wells containing human IgGs and 22 wells containing the solubilized proteins of HEK cell membranes, each cell expressing a different membrane protein chosen from the proteins identified in Table 2 (referenced SEQ ID NO: 1 to SEQ ID NO: 311) and not expressed by the cells used to prepare plate 1.

C. Control plate (the correct expression is verified using the V5 tag alone).

D. Example of non-specific response.

E. Example of negative response.

F. Example of positive response.

EXAMPLES

Example 1—Preparation of a Protein Chip According to the Invention and Developing of the Proteins Bound Materials and Method Cloning The inventors used the pcDNA6.2-TOPO/GW/V5 expression vector (Invitrogen Cat#K2460-20). The majority of the primers were ordered from Eurogentec and the rest from Sigma.

The PCR is carried out on a Thermocycler machine (Biometra) with a commercial mixture of polymerases (HF enzyme mix from Fermentas cat#K0192). The amplification protocol is of the 2-step type with an extension and amplification temperature at 68° C.

The template for the amplification of the genes of interest is mainly derived from a cDNA library prepared from mRNA of healthy human brain (Invitrogen). The reverse transcription of this mRNA into cDNA is carried out using a SuperScript III (Invitrogen) according to the maker's protocol.

In the event of failed amplification of the gene of interest (either because of too little expression of this gene in the brain and, therefore, of the difficulty in amplifying it from this cDNA library, or because of the nucleotide nature of this gene, or else for another undetermined reason), another source of RNA (human cells of HEK type, for example) is used or a plasmid construct is used when it is available.

The PCR-amplified genes are separated from the dNTPs and from the template by (1%) agarose gel electrophoresis. The DNA bands of molecular weights corresponding to the genes of interest are cut out of the gel and purified on a column (of the "gel extraction purification" type from Qiagen, Promega or Macherey-Nagel). The amplified genes thus purified are then inserted into the expression vector according to the maker's guidelines (TOPO cloning, Invitrogen).

The plasmid constructs thus created are screened by bacterial transformation. Plated out on bacterial culture dishes, they are selected with an antibiotic of ampicillin type. The positive bacteria (of TOP10 type, Invitrogen) are placed in liquid culture the next day with the same antibiotic selection. This bacterial culture amplification makes it possible to amplify the amount of DNA available. This amplified DNA is purified on a column (of miniprep type, Qiagen). The plasmids that may have incorporated the gene of interest are sequenced using a sequencing platform. The sequencing primers are the T7 forward primer and a reverse primer specific for the pcDNA6.2-TOPO/GW/V5 vector. Only the beginning and the end of the sequence of the gene are verified by sequencing. This is because the subsequent detection of the presence of the tag (ta-V5g) in the cells in culture will by itself attest to the integrity of the protein.

Cell Culture

The inventors use the HEK293A human cell strain (Invitrogen Cat# R70507) as protein production system.

For the cell transfection, the inventors used jetPEI (Ozyme cat#101-10) as transfecting agent.

The inventors transfected a first series of cells on glass coverslips precoated with poly-L-Lysine in order to facilitate their adhesion.

Two days after the transfection, the inventors verify the presence of the Tag-V5 by immunofluorescence. The primary antibody directed against the V5 tag is a rabbit anti-V5 polyclonal antibody (Covance Cat#PRB189P). The anti-rabbit secondary antibody is coupled to a fluorophore of Alexa488 or Alexa594 type (Invitrogen). This detection finishes the validation of the cloning of the gene of interest.

A second cell culture series of dishes 60 mm in diameter, with the same transfecting agent (jet-PEI), makes it possible to produce a larger amount of cells. Two days after the transfection of the construct containing the gene of interest, the cells are recovered in the following way:

The culture medium is removed.

The cells are rinsed with 1 ml of PBS which is immediately suctioned off.

The cells are again rinsed with 1 ml of PBS.

They are left for 10 minutes at ambient temperature (AT).

All of the subsequent procedure is advantageously carried out in ice.

With a micropipette (P1000+filter tips), the cells are detached by repeated and careful projection of the PBS contained in the dish.

The resuspended cells are transferred into a 1.5 ml centrifugation tube (Eppendorf type).

The cells are centrifuged for 5 minutes at 14K RPM (revolutions per minute) and at 4° C. in a bench centrifuge.

The supernatant is removed.

The cells are resuspended in 50 µl of solubilization buffer prepared, for example, as follows:
40% glycerol, 2% CHAPS, 140 mM NaCl, 2 mM EDTA, 20 mM Tris, pH8.8, in PBS to which an anti-protease mix of "Complete" type (from Roche) has been added.

The cells are solubilized in this buffer by pipetting up and down approximately 50 times. Still in the microfuge tube, the solubilisate is left in ice for one hour.

A centrifugation is carried out for 10 minutes at 2500 RPM (revolutions per minute), and at 4° C.

The supernatant is transferred into a clean tube, DNA loading buffer is added, and the mixture is stored at −80° C.

Once the collection of several solubilisates of various cultures and of various expressed proteins has been established, these soluble proteins are distributed into conical-bottom 96-well plates, advantageously using the 24 central wells.

While maintaining these plates on ice, a fraction of each solubilisate is sampled using a multiwell replicator and a footprint is produced in triplicate on a nitrocellulose membrane (Hybond-C Extra Cat#RPM303C, Amersham).

This membrane constitutes the support for the 24 solubilisates to be tested with the sample from a patient. An identical footprint is produced in order to verify the correct expression of the V5-tagged proteins in each solubilisate.

On the day of the test, the footprinted membranes are cut to the size limit of the 24 wells. (One corner is notched in order to orient the membrane).

This membrane is rolled up and introduced into a 5 ml hemolysis tube.

It is ensured that the entire surface area of the membrane is uniformly distributed inside the tube.

This membrane is incubated for 15 minutes with 2 ml of blocking solution (PBS, 5% milk, 0.2% NP40).

This blocking medium is replaced with 750 µl to 1 ml of antibody solution at $\frac{1}{20}^{th}$ (50 µl of CSF in 1 ml of blocking solution). Everything is incubated overnight at ambient temperature on a rotary machine.

The incubation medium is recovered and frozen for a second use.

Each membrane is rinsed three times in the hemolysis tubes with the rinsing solution (PBS, 0.1% NP40).

Incubation is carried out for 2 hours at ambient temperature with the secondary antibody (diluted to $\frac{1}{5000}^{th}$ in the blocking solution (PBS, 5% milk, 0.2% NP40)). The secondary antibody is coupled to HRP (horseradish peroxidase) (anti-human and anti-rabbit from Jackson ImmunoResearch).

Rinsing is carried out three times with the rinsing solution (PBS, 0.1% NP40) and once with PBS alone.

The blots are developed with 500 µl of ECL (enhanced chemiluminescence) (Pierce) in the developing machine (FujiFilm Fluorescent Image Analyzer FLA-3000).

Example 2—Validation of the Efficiency of the Protein Chip

In the present example, samples (of CSF type) originating from a cohort of patients known to have antibodies directed against the NMDA receptor subunit NR1 (initially detected using an immunocytology method) and also samples originating from individuals not suffering from an autoimmune disease are used to validate the efficiency of the protein chip according to the invention.

The invention was validated by means of a blind test carried out on various samples originating from 17 patients known to contain anti-NR1 antibodies (in a population consisting of 26 healthy individuals).

According to the protocol described above, the membrane proteins of cells expressing the NR1 receptor are solubilized and deposited on a nitrocellulose membrane. Each membrane has four deposits of the protein of interest corresponding to four decreasing dilutions of the same solubilized membrane protein preparation resulting from cells overexpressing the NR1 subunit, one control deposit corresponding to solubilized membrane proteins from cells expressing the empty vector, and one control deposit corresponding to a solution of human serum from a healthy subject (see FIG. 1). After incubation and detection as described above, the results show that, of the 17 afflicted patients, the test recognized 15 thereof and therefore has an efficiency of 88%. The specificity for the negative patients is 100%. The two false positives recognized by the protein chip according to the invention correspond to two candidates who had been detected as positive and then discarded in a second screening of a first test carried out on cells.

Example 3—Screening Using the Protein Chip

In the present example, the invention was tested on a cohort of 50 patients suffering from neurological disorders of unknown origin (and which were potentially autoimmune) for whom the inventors sought to know whether they had antibodies directed against one or more proteins among 40 proteins deposited on a nitrocellulose membrane.

In this example, each plate (FIG. 2) possesses 20 samples of solubilized membrane proteins from cells individually overexpressing 20 proteins of interest (codified here in A15, F28, F31, etc.) and also two samples corresponding to a dilution of human serum from a healthy subject.

Figure 2:
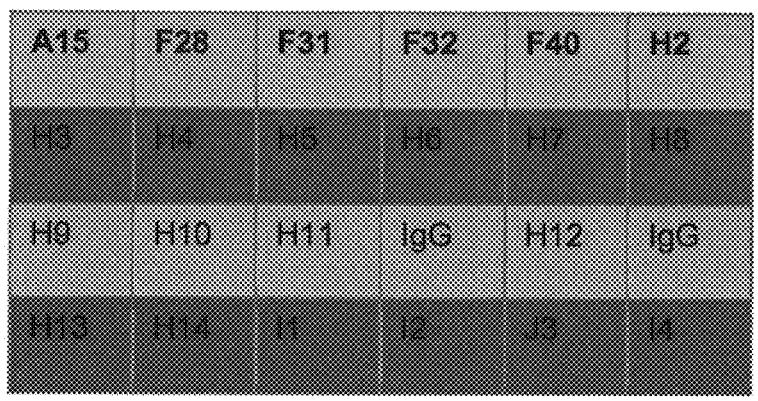
Figure 2:
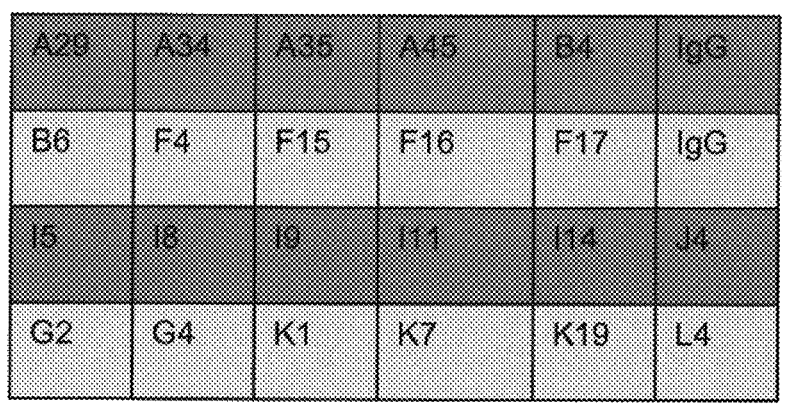
Figure 2:
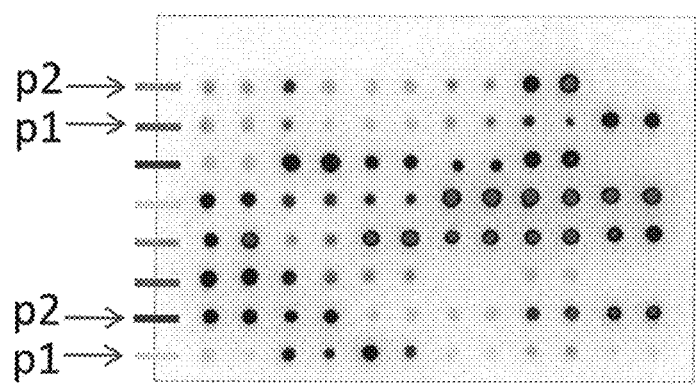
Figure 2:
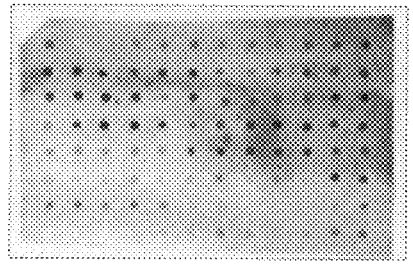
Figure 2:
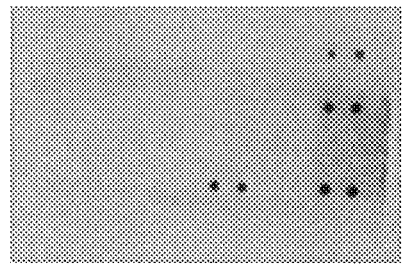
Figure 2:
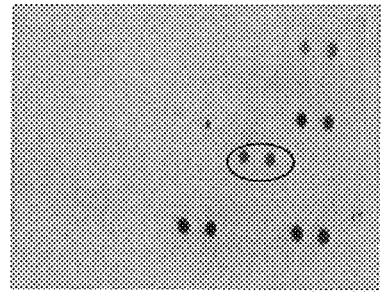

The deposits on nitrocellulose membrane were carried out according to the protocol described above (with a replicator) in duplicate and while combining the deposits of the two plates (plate 1 at the bottom, plate 2 at the top) on the same membrane (see FIG. 2).

The results show that, among the 50 patients tested, many patients were negative and therefore did not have antibodies directed against one of the 40 proteins deposited, a small number had antibodies against all the proteins deposited, and one patient had antibodies directed specifically against one protein (H7).

After comparison of these results with the clinical picture of the cohort of 50 patients, it appears that the non-specific response of the patients having antibodies directed against all the proteins is partly explained by the degree of advancement and of severity of their disease, since most of them died even before the test was set up (massive and non-specific immune response). On the other hand, the sole result regarding the H7 protein is the perfect example of the possible identification, using the chip according to the invention, of the association (demonstrated for the first time) that exists between a particular channel (protein identified in the present example as the H7 protein) and a neurological disease.

SEQUENCE LISTING (312 sequences)

SEQ ID NO: 1 - protein, 484 aa, Homo sapiens
MLGKLAMLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 2 - protein, 516 aa, Homo sapiens
MLGKLAMLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGKAPPGSRAQSGEKPAPSHLLHVSLASALGCTGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 3 - protein, 441 aa, Homo sapiens
MLSSVMAPLWACILVAAGILATDTHHPQDSALYHLSKQLLQKYHKEVRPVYNWTKATTVYLDLFVHAILDVDAENQILKTSVWYQEVWNDEFLSWNSSMFDEIREISLPLSAIWAPDIIINEFVDIERYPDLPYVYVNSSGTIENYKPIQVVSACSLETYAFPFDVQNCSLTFKSILHTVEDVDLAFLRSPEDIQHDKKAFLNDSEWELLSVSSTYSILQSSAGGFAQIQFNVVMRRHPLVYVVSLLIPSIFLMLVDLGSFYLPPNCRARIVFKTSVLVGYTVFRVNMSNQVPRSVGSTPLIGHFFTICMAFLVLSLAKSIVLVKFLHDEQRGGQEQPFLCLRGDTDADRPRVEPRAQRAVVTESSLYGEHLAQPGTLKEVWSQLQSISNYLQTQDQTDQQEAEWLVLLSRFDRLLFQSYLFMLGIYTITLCSLWALWGGV

SEQ ID NO: 4 - protein, 447 aa, Homo sapiens
MEGGWPARQSALLCLTVSLLLQGRGDAFTINCSGFDQHGVDPAVFQAVFDRKAFRPFTNYSIPTRVNISFTLSAILGVDAQLQLLTSFLWMDLVWDNPFINWNPKECVGINKLTVLAENLWLPDIFIVESMDVDQTPSGLTAYISSEGRIKYDKPMRVTSICNLDIFYFPFDQQNCTFTFSSFLYTVDSMLLGMDKEVWEITDTSRKVIQTQGEWELLGINKATPKMSMGNNLYDQIMFYVAIRRRPSLYIINLLVPSSFLVAIDALSFYLPAESENRAPFKITLLLGYNVFLLMMNDLLPASGTPLISVYFALCLSLMVVSLLETVFITYLLHVATTQPPPMPRWLHSLLLHCTSPGRCCPTAPQKGNKGLGLTLTHLPGPKEPGELAGKKLGPRETEPDGGSGWTKTQLMELWVQFSHAMDTLLFRLYLLFMASSILTVIVLWNT

SEQ ID NO: 5 - protein, 279 aa, Homo sapiens
MASMSIVKATSNTISQCGWSASANWTPSISPSMDRGERSPSALSPTQVAIRRRCRPSPYVVNFLVPSGILIAIDALSFYLPLESGNCAPFKMTVLLGYSVFLLMMNDLLPATSTSSHASLVRPHPSRDQKRGVYFALCLSLMVGSLLETIFITHLLHVATTQPLPLPRWLHSLLLHCTGQGRCCPTAPQKGNKGPGLTPTHLPGVKEPEVSAGQMPGPGEAELTGGSEWTRAQREHEAQKQHSVELWVQFSHAMDALLFRLYLLFMASSIITVICLWNT

SEQ ID NO: 6 - protein, 471 aa, Homo sapiens
MLAFILSRATPRPALGPLSYREHRVALLHLTHSMSTTGRGVTFTINCSGFGQHGADPTALNSVFNRKPFRPVTNISVPTQVNISFAMSAILDVNEQLHLLSSFLWLEMVWDNPFISWNPEECEGITKMSMAAKNLWLPDIFIIELMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 7 - protein, 482 aa, Homo sapiens
MEPWPLLLLFSLCSAGLVLGSEHETRLVAKLFKDYSSVVRPVEDHRQVVEVTVGLQLIQLINVDEVNQIVTTNVRLKQGDMVDLPRPSCVTLGVPLFSHLQNEQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 8 - protein, 529 aa, Homo sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 9 - protein, 505 aa, Homo sapiens
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEIQDDWKYVAMVIDRIFLWVFTLVCILGTAGLFLQPLMAREDA

SEQ ID NO: 10 - protein, 627 aa, Homo sapiens
MELGGPGAPRLLPPLLLLLGTGLLRASSHVETRAHAEERLLKKLFSGYNKWSRPVANISDVVLVRFGLSIAQLIDVDEKNQMMTTNVWVKQEWHDYKLRWDPADYENVTSIRIPSELIWRPDIVLYNNADGDFAVTHLTKAHLFHDGRVQWTPPAIYKSSCSIDVTFFPFDQQNCTMKFGSWTYDKAKIDLVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVKEDWKYVAMVIDRIFLWMFIIVCLLGTVGLFLPPWLAGMI

SEQ ID NO: 11 - protein, 468 aa, Homo sapiens
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWYPYVTYSFVIKRLPLFYTLFLIIPCIGLSFLTVLVFYLPSNEGEKICLCTSVLVSLTVFLLVIEEIIPSSSKVIPLIGEYLVFTMIFVTLSIMVTVFAINIHHRSSSTHNAMAPLVRKIFLHTLPKLLCMRSHVDRYFTQKEETESGSGPKSSRNTLEAALDSIRYITRHIMKENDVREVVEDWKFIAQVLDRMFLWTFLFVSIVGSLGLFVPVIYKWANILIPVHIGNANK

SEQ ID NO: 12 - protein, 494 aa, Homo sapiens
MLTSKGQGFLHGGLCLWLCVFTPFFKGCVGCATEERLFHKLFSHYNQFIRPVENVSDPVTVHFEVAITQLANVDEVNQIMETNLWLRHIWNDYKLRWDPMEYDGIETLRVPADKIWKPDIVLYNNAVGDFQVEGKTKALLKYNGMITWTPPAIFKSSCPMDITFFPFDHQNCSLKFGSWTYDKAEIDLLIIGSKVDMNDFWENSEWEIIDASGYKHDIKYNCCEEIYTDITYSFYIRRLPMFYTINLIIPCLFISFLTVLVFYLPSDCGEKVTLCISVLLSLTVFLLVITETIPSTSLVVPLVGEYLLFTMIFVTLSIVVTVFVLNIHYRTPTTHTMPRWVKTVFLKLLPQVLLMRWPLDKTRGTGSDAVPRGLARRPAKGKLASHGEPRHLKECFHCHKSNELATSKRRLSHQPLQWVVENSEHSPEVEDVINSVQFIAENMKSHNETKEVEDDWKYVAMVVDRVFLWVFIIVCVFGTAGLFLQPLLGNTGKS

SEQ ID NO: 13 - protein, 502 aa, Homo sapiens
MRCSPGGVWLALAASLLHVSLQGEFQRKLYKELVKNYNPLERPVANDSQPLTVYFSLSLLQIMDVDEKNQVLTTNIWLQMSWTDHYLQWNVSEYPGVKTVRFPDGQIWKPDILLYNSADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 14 - protein, 479 aa, Homo sapiens
MNWSHSCISFCWIYFAASRLRAAETADGKYAQKLFNDLFEDYSNALRPVEDTDKVLNVTLQITLSQIKDMDERNQILTAYLWIRQIWHDAYLTWDRDQYDGLDSIRIPSDLVWRPDIVLYNKADDESSEPVNTNVVLRYDGLITWDAPAITKSSCVVDVTYFPFDNQQCNLTFGSWTYNGNQVDIFNALDSGDLSDFIEDVEWEVHGMPAVKNVISYGCCSEPYPDVTFTLLLKRRSSFYIVNLLIPCVLISFLAPLSFYLPAASGEKVSLGVTILLAMTVFQLMVAEIMPASENVPLIGKYYIATMALITASTALTIMVMNIHFCGAEARPVPHWARVVILKYMSRVLFVYDVGESCLSPHHSRERDHLTKVYSKLPESNLKAARNKDLSRKKDMNKRLKNDLGCQGKNPQEAESYCAQYKVLTRNIEYIAKCLKDHKATNSKGSEWKKVAKVIDRFFMWIFFIMVFVMTILIIARAD

SEQ ID NO: 15 - protein, 450 aa, Homo sapiens
MGLRSHHLSLGLLLLFLLPAECLGAEGRLALKLFRDLFANYTSALRPVADTDQTLNVTLEVTLSQIIDMDERNQVLTLYLWIRQEWTDAYLRWDPNAYGGLDAIRIPSSLVWRPDIVLYNKADAQPPGSASTNVVLRHDGAVRWDAPAITRSSCRVDVAAFPFDAQHCGLTFGSWTHGGHQLDVRPRGAAASLADFVENVEWRVLGMPARRRVLTYGCCSEPYPDVTFTLLLRRRAAAYVCNLLLPCVLISLLAPLAFHLPADSGEKVSLGVTVLLALTVFQLLLAESMPPAESVPLIGKYYMATMTMVTFSTALTILIMNLHYCGPSVRPVPAWARALLLGHLARGLCVRERGEPCGQSRPPELSPSPQSPEGGAGPPAGPCHEPRCLCRQEALLHHVATIANTFRSHRAAQRCHEDWKRLARVMDRFFLAIFFSMALVMSLLVLVQAL

SEQ ID NO: 16 - protein, 501 aa, Homo sapiens
MTPGALLMLLGALGAPLAPGVRGSEAEGRLREKLFSGYDSSVRPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 17 - protein, 502 aa, Homo sapiens
MARRCGPVALLLGFGLLRLCSGVWGTDTEERLVEHLLDPSRYNKLIRPATNGSELVTVQLMVSLAQLISVHEREQIMTTNVWLTQEWEDYRLTWKPEEFDNMKKVRLPSKHIWLPDVVLYNNADGMYEVSFYSNAVVSYDGSIFWLPPAIYKSACKIEVKHFPFDQQNCTMKFRSWTYDRTEIDLVLKSEVASLDDFTPSGEWDIVALPGRRNENPDDSTYVDITYDFIIRRKPLFYTINLIIPCVLITSLAILVFYLPSDCGEKMTLCISVLLALTVFLLLISKIVPPTSLDVPLVGKYLMFTMVLVTFSIVTSVCVLNVHHRSPTTHTMAPWVKVVFLEKLPALLFMQQPRHHCARQRLRLRRRQREREGAGALFFREAPGADSCTCFVNRASVQGLAGAFGAEPAPVAGPGRSGEPCGCGLREAVDGVRFIADHMRSEDDDQSVSEDWKYVAMVIDRLFLWIFVFVCVFGTIGMFLQPLFQNYTTTTFLHSDHSAPSSK

SEQ ID NO: 18 - protein, 458 aa, Homo sapiens
MLPDFMLVLIVLGIPSSATTGFNSIAENEDALLRHLFQGYQKWVRPVLHSNDTIKVYFGLKISQLVDVDEKNQLMTTNVWLKQEWTDHKLRWNPDDYGGIHSIKVPSESLWLPDIVLFENADGRFEGSLMTKVIVKSNGTVVWTPPASYKSSCTMDVTFFPFDRQNCSMKFGSWTYDGTMVDLILINENVDRKDFFDNGEWEILNAKGMKGNRRDGVYSYPFITYSFVLRRLPLFYTLFLIIPCLGLSFLTVLVFYLPSDEGEKLSLSTSVLVSLTVFLLVIEEIIPSSSKVIPLIGEYLLFIMIFVTLSIIVTVFVINVHHRSSSTYHPMAPWVKRLFLQKLPKLLCMKDHVDRYSSPEKEESQPVVKGKVLEKKKQKQLSDGEKVLVAFLEKAADSIRYISRHVKKEHFISQVVQDWKFVAQVLDRIFLWLFLIVSVTGSVLIFTPALKMWLHSYH

SEQ ID NO: 19 - protein, 498 aa, Homo sapiens
MRRAPSLVLFFLVALCGRGNCRVANAEEKLMDDLLNKTRYNNLIRPATSSSQLISIKLQLSLAQLISVNEREQIMTTNVWLKQEWTDYRLTWNSSRYEGVNILRIPAKRIWLPDIVLYNNADGTYEVSVYTNLIVRSNGSVLWLPPAIYKSACKIEVKYFPFDQQNCTLKFRSWTYDHTEIDMVLMTPTASMDDFTPSGEWDIVALPGRRTVNPQDPSYVDVTYDFIIKRKPLFYTINLIIPCVLTTLLAILVFYLPSDCGEKMTLCISVLLALTFFLLLISKIVPPTSLDVPLIGKYLMFTMVLVTFSIVTSVCVLNVHHRSPSTHTMAPWVKRCFLHKLPTFLFMKRPGPDSSPARAFPPSKSCVTKPEATATSTSPSNFYGNSMYFVNPASAASKSPAGSTPVAIPRDFWLRSSGRFRQDVQEALEGVSFIAQHMKNDDEDQSVVEDWKYVAMVVDRLFLWVFMFVCVLGTVGLFLPPLFQTHAASEGPYAAQRD

SEQ ID NO: 20 - protein, 517 aa, Homo sapiens
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDAKENRTYPVEWIIIDPEGFTENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 21 - protein, 493 aa, Homo sapiens
MARAPLGVLLLLGLLGRGVGKNEELRLYHHLFNNYDPGSRPVREPEDTVTISLKVTLTNLISLNEKEETLTTSVWIGIDWQDYRLNYSKDDFGGIETLRVPSELVWLPEIVLENNIDGQFGVAYDANVLVYEGGSVTWLPPAIYRSVCAVEVTYFPFDWQNCSLIFRSQTYNAEEVEFTFAVDNDGKTINKIDIDTEAYTENGEWAIDFCPGVIRRHHGGATDGPGETDVIYSLIIRRKPLFYVINIIVPCVLISGLVLLAYFLPAQAGGQKCTVSINVLLAQTVFLFLIAQKIPETSLSVPLLGRFLIFVMVVATLIVMNCVIVLNVSQRTPTTHAMSPRLRHVLLELLPRLLGSPPPPEAPRAASPPRRASSVGLLLRAEELILKKPRSELVFEGQRHRQGTWTAAFCQSLGAAAPEVRCCVDAVNFVAESTRDQEATGEEVSDWVRMGNALDNICFWAALVLFSVGSSLIFLGAYFNRVPDLPYAPCIQP

SEQ ID NO: 22 - protein, 517 aa, Homo sapiens
MHGGQGPLLLLLLLAVCLGAQGRNQEERLLADLMQNYDPNLRPAERDSDVVNVSLKLTLTNLISLNEREEALTTNVWIEMQWCDYRLRWDPRDYEGLWVLRVPSTMVWRPDIVLENNVDGVFEVALYCNVLVSPDGCIYWLPPAIFRSACSISVTYFPFDWQNCSLIFQSQTYSTNEIDLQLSQEDGQTIEWIFIDPEAFTENGEWAIQHRPAKMLLDPAAPAQEAGHQKVVFYLLIQRKPLFYVINIIAPCVLISSVAILIHFLPAKAGGQKCTVAINVLLAQTVFLFLVAKKVPETSQAVPLISKYLTFLLVVTILIVVNAVVVLNVSLRSPHTHSMARGVRKVFLRLLPQLLRMHVRPLAPAAVQDTQSRLQNGSSGWSITTGEEVALCLPRSELLFQQWQRQGLVAAALEKLEKGPELGLSQFCGSLKQAAPAIQACVEACNLIACARHQQSHFDNGNEEWFLVGRVLDRVCFLAMLSLFICGTAGIFLMAHYNRVPALPFPGDPRPYLPSPD

SEQ ID NO: 23 - protein, 456 aa, Homo sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGYAWDGKSVVPEKPKKVKDPLIKKNNTYAPTATSYTPNLARGDPGLATIAKSATIEPKEVKPETKPPEPKKTFNSVSKIDRLSRIAFPLLFGIFNLVYWATYLNREPQLKAPTPHQ

SEQ ID NO: 24 - protein, 451 aa, Homo sapiens
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 25 - protein, 492 aa, Homo sapiens
MIITQTSHCYMTSLGILFLINILPGTTGQGESRRQEPGDFVKQDIGGLSPKHAPDIPDDSTDNITIFTRILDRLLDGYDNRLRPGLGDAVTEVKTDIYVTSFGPVSDTDMEYTIDVFFRQTWHDERLKFDGPMKILPLNNLLASKIWTPDTFFHNGKKSVAHNMTTPNKLLRLVDNGTLLYTMRLTIHAECPMHLEDFPMDVHACPLKFGSYAYTTAEVVYSWTLGKNKSVEVAQDGSRLNQYDLLGHVVGTEIIRSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRSWAWEGKKVPEALEMKKKTPAAPAKKTSTTFNIVGTTYPINLAKDTEFSTISKGAAPSASSTPTIIASPKATYVQDSPTETKTYNSVSKVDKISRIIFPVLFAIFNLVYWATYVNRESAIKGMIRKQ

SEQ ID NO: 26 - protein, 554 aa, Homo sapiens [sequence omitted]

SEQ ID NO: 27 - protein, 462 aa, Homo sapiens
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMRLTISAECPMQLEDFPMDAHACPLKFGSYAYPNSEVVYVWTNGSTKSVVVAEDGSRLNQYHLMGQTVGTENISTSTGEYTIMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKKALEAAKIKKKREVILNKSTNAFTTGKMSHPPNIPKEQTPAGTSNTTSVSVKPSEEKTSESKKTYNSISKIDKMSRIVFPVLFGTFNLVYWATYLNREPVIKGAASPK

SEQ ID NO: 28 - protein, 453 aa, Homo sapiens
MASSLPWLCIILWLENALGKLEVEGNFYSENVSRILDNLLEGYDNRLRPGFGGAVTEVKTDIYVTSFGPVSDVEMEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVILSQVSFWINKESVPARTVFGITTVLTMTTLSISARHSLPKVSYATAMDWFIAVCFAFVFSALIEFAAVNYFTNLQTQKAKRKAQFAAPPTVTISKATEPLEAEIVLHPDSKYHLKKRITSLSLPIVSSSEANKVLTRAPILQSTPVTPPPLSPAFGGTSKIDQYSRILFPVAFAGFNLVYWVVYLSKDTMEVSSSVE

SEQ ID NO: 29 - protein, 474 aa, Homo sapiens
MWTVQNRESLGLLSFPVMITMVCCAHSTNEPSNMSYVKETVDRLLKGYDIRLRPDFGGPPVDVGMRIDVASIDMVSEVNMDYTLTMYFQQSWKDKRLSYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWNGGEGAVTGVNKIELPQFSIVDYKMVSKKVEFTTGAYPRLSLSFRLKRNIGYFILQTYMPSTLITILSWVSFWINYDASAARVALGITTVLTMTTISTHLRETLPKIPYVKAIDIYLMGCFVFVFLALLEYAFVNYIFFGKGPQKKGASKQDQSANEKNKLEMNKVQVDAHGNILLSTLEIRNETSGSEVLTSVSDPKATMYSYDSASIQYRKPLSSREAYGRALDRHGVPSKGRIRRRASQLKVKIPDLTDVNSIDKWSRMFFPITFSLFNVVYWLYYVH

SEQ ID NO: 30 - protein, 512 aa, Homo sapiens
MWRVRKRGYFGIWSFPLIIAAVCAQSVNDPSNMSLVKETVDRLLKGYDIRLRPDFGGPPVAVGMNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKIFYKDIKQNGTQYRSLWDPTGNLSPTRRTTNYDFSLYTMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 31 - protein, 474 aa, Homo sapiens
MWRVRKRGYFGIWSFPLIIAAVCAQSVNDPSNMSLVKETVDRLLKGYDIRLRPDFGGPPVAVGMNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 32 - protein, 473 aa, Homo sapiens [sequence omitted]

SEQ ID NO: 33 - protein, 452 aa, Homo sapiens [sequence omitted]

SEQ ID NO: 34 - protein, 506 aa, Homo sapiens
MLSKVLPVLLGILLILQSRVEGPQTESKNEASSRDVVYGPQPQPLENQLLSEETKSTETETGSRVGKLPEASRILNTILSNYDHKLRPGIGEKPTVVTVEISVNSLGPLSILDMEYTIDIIFSQTWYDERLCYNDTFESLVLNGNVVSQLWIPDTFFRNSKRTHEHEITMPNQMVRIYKDGKVLYTIRMTIDAGCSLHMLRFPMDSHSCPLSFSSFSYPENEMIYKWENFKLEINEKNSWKLFQFDFTGVSNKTEIITTPVGDFMVMTIFFNVSRRFGYVAFQNYVPSSVTTMLSWVSFWIKTESAPARTSLGITSVLTMTTLGTFSRKNFPRVSYITALDFYIAICFVFCFCALLEFAVLNFLIYNQTKAHASPKLRHPRINSRAHARTRARSRACARQHQEAFVCQIVTTEGSDGEERPSCSAQQPPSPGSPEGPRSLCSKLACCEWCKRFKKYFCMVPDCEGSTWQQGRLCIHVYRLDNYSRVVFPVTFFFFNVLYWLVCLNL

SEQ ID NO: 35 - protein, 465 aa, Homo sapiens
MGPLKAFLFSPFLLRSQSRGVRLVFLLLTLHLGNCVDKADDEDDEDLTVNKTWVLAPKIHEGDITQILNSLLQGYDNKLRPDIGVRPTVIETDVYVNSIGPVDPINMEYTIDIIFAQTWFDSRLKFNSTMKVLMLNSNMVGKIWIPDTFFRNSRKSDAHWITTPNRLLRIWNDGRVLYTLRLTINAECYLQLHNFPMDEHSCPLEFSSYGYPKNEIEYKWKKPSVEVADPKYWRLYQFAFVGLRNSTEITHTISGDYVIMTIFFDLSRRMGYFTIQTYIPCILTVVLSWVSFWINKDAVPARTSLGITTVLTMTTLSTIARKSLPKVSYVTAMDLFVSVCFIFVFAALMEYGTLHYFTSNQKGKTATKDRKLKNKASMTPGLHPGSTLIPMNNISVPQEDDYGYQCLEGKDCASFFCCFEDCRTGSWREGRIHIRIAKIDSYSRIFFPTAFALFNLVYWVGYLYL

SEQ ID NO: 36 - protein, 475 aa, Homo sapiens
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPLLRMFSFKAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 37 - protein, 467 aa, Homo sapiens
MAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSNYSLLDMRPPPTAMITLNNSVYWQEFEDTCVYECLDGKDCQSFFCCYEECKSGSWRKGRIHIDILELDSYSRVFFPTSFLLFNLVYWVGYLYL

SEQ ID NO: 38 - protein, 440 aa, Homo sapiens
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGVTTVLSMTTLMIGSRTSLPNTNCFIKAIDVYLGICFSFVFGALLEYAVAHYSSLQQMAAKDRGTTKEVEEVSITNIINSSISSFKRKISFASIEISSDNVDYSDLTMKTSDKFKFVFREKMGRIVDYFTIQNPSNVDHYSKLLFPLIFMLANVFYWAYYMYF

SEQ ID NO: 39 - protein, 479 aa, Homo sapiens
MLAVPNMRFGIFLLWWGWVLATESRMHWPGREVHEMSKKGRPQRQRREVHEDAHKQVSPILRRSPDITKSPLTKSEQLLRIDDHDFSMRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRIDTHAIDKYSRIIFPAAYILFNLIYWSIFS

SEQ ID NO: 40 - protein, 490 aa, Homo sapiens
MVKPGGICSATGYWKAAFCLTDVHKMPYFTRLILFLFCLMVLVESRKPKRKRWTGQVEMPKPSHLYKKNLDVTKIRKGKPQQLLRVDEHDFSMRPAFGGPAIPVGVDVQVESLDSISEVDMDFTMTLYLRHYWKDERLAFSSASNKSMTFDGRLVKKIWVPDVFFVHSKRSFTHDTTTDNIMLRVFPDGHVLYSMRITVTAMCNMDFSHFPLDSQTCSLELESYAYTDEDLMLYWKNGDESLKTDEKISLSQFLIQKFHTTSRLAFYSSTGWYNRLYINFTLRRHIFFFLLQTYFPATLMVMLSWVSFWIDRRAVPARVSLGITTVLTMTTIITGVNASMPRVSYVKAVDIYLWVSFVFVFLSVLEYAAVNYLTTVQERKERKLREKFPCMCGMLHSKTMMLDGSYSESEANSLAGYPRSHILTEEERQDKIVVHLGLSGEANAARKKGLLKGQTGFRIFQNTHAIDKYSRLIFPASYIFFNLIYWSVFS

SEQ ID NO: 41 - protein, 467 aa, Homo sapiens
MVLAFQLVSFTYIWIILKPNVCAASNIKMTHQRCSSSMKQTCKQETRMKKDDSTKARPQKYEQLLHIEDNDFAMRPGFGGSPVPVGIDVHVESIDSISETNMDFTMTFYLRHYWKDERLSFPSTANKSMTFDHRLTRKIWVPDIFFVHSKRSFIHDTTMENIMLRVHPDGNVLLSLRITVSAMCFMDFSRFPLDTQNCSLELESYAYNEDDLMLYWKHGNKSLNTEEHMSLSQFFIEDFSASSGLAFYSSTGWYNRLFINFVLRRHVFFFVLQTYFPAILMVMLSWVSFWIDRRAVPARVSLGITTVLTMSTIITAVSASMPQVSYLKAVDVYLWVSSLFVFLSVIEYAAVNYLTTVEERKQFKKTGKISRMYNIDAVQAMAFDGCYHDSEIDMDQTSLSLNSEDFMRRKSICSPSTDSSRIKRRKSLGGHVGRIILENNHVIDTYSRILFPIVYILFNLFYWGVYV

SEQ ID NO: 42 - protein, 632 aa, Homo sapiens
MGIRGMLRAAVILLLIRTWLAEGNYPSPIPKFHFEFSSAVPEVVLNLFNCKNCANEAVVQKILDRVLSRYDVRLRPNFGGAPVPVRISIYVTSIEQISEMNMDYTITMFFHQTWKDSRLAYYETTLNLTLDYRMHEKLWVPDCYFLNSKDAFVHDVTVENRVFQLHPDGTVRYGIRLTTTAACSLDLHKFPMDKQACNLVVESYGYTVEDIILFWDDNGNAIHMTEELHIPQFTFLGRTITSKEVYFYTGSYIRLILKFQVQREVNSYLVQVYWPTVLTTITSWISFWMNYDSSAARVTIGLTSMLILTTIDSHLRDKLPNISCIKAIDIYILVCLFFVFLSLLEYVYINYLFYSRGPRRQPRRHRRPRRVIARYRYQQVVVGNVQDGLINVEDGVSSLPITPAQAPLASPESLGSLTSTSEQAQLATSESLSPLTSLSGQAPLATGESLSDLPSTSEQARHSYGVRFNGFQADDSIFPTEIRNRVEAHGHGVTHDHEDSNESLSSDERHGHGPSGKPMLHHGEKGVQEAGWDLDDNNDKSDCLAIKEQFKCDTNSTWGLNDDELMAHGQEKDSSSESEDSCPPSPGCSFTEGFSFDLFNPDYVPKVDKWSRFLFPLAFGLFNIVYWVYHMY

SEQ ID NO: 43 - protein, 449 aa, Homo sapiens
MYSFNTLRLYLWETIVFFSLAASKEAEAARSAPKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 44 - protein, 452 aa, Homo sapiens [sequence omitted]

SEQ ID NO: 45 - protein, 464 aa, Homo sapiens
MAHVRHFRTLVSGFYFWEAALLLSLVATKETDSARSRSAPMSPSDFLDKLMGRTSGYDARIRPNFKGPPVNVTCNIFINSFGSIAETTMDYRVNIFLRQKWNDPRLAYSEYPDDSLDLDPSMLDSIWKPDLFFANEKGANFHEVTTDNKLLRIFKNGNVLYSIRLTLTLSCPMDLKNFPMDVQTCIMQLESFGYTMNDLIFEWQDEAPVQVAEGLTLPQFLLKEEKDLRYCTKHYNTGKFTCIEVRFHLERQMGYYLIQMYIPSLLIVILSWVSFWINMDAAPARVALGITTVLTMTTQSSGSRASLPKVSYVKAIDIWMAVCLLFVFSALLEYAAVNFVSRQHKELLRFRRKRKNKTEAFALEKFYRFSDMDDEVRESRFSFTAYGMGPCLQAKDGMTPKGPNHPVQVMPKSPDEMRKVFIDRAKKIDTISRACFPLAFLIFNIFYWVIYKILRHEDIHQQQD

SEQ ID NO: 46 - protein, 417 aa, Homo sapiens
MTTLVPATLSFLLLWTLPGQVLLRVALAKEEVKSGTKGSQPMSPSDFLDKLMGRTSGYDARIRPNFKGPPVNVTCNIFINSFSSITKTTMDYRVNVFLRQQWNDPRLSYREYPDDSLDLDPSMLDSIWKPDLFFANEKGANFHEVTTDNKLLRIFKNGNVLYSIRLTLILSCLMDLKNFPMDIQTCTMQLESFGYTMKDLVFEWLEDAPAVQVAEGLTLPQFILRDEKDLGCCTKHYNTGKFTCIEVKFHLERQMGYYLIQMYIPSLLIVILSWVSFWINMDAAPARVGLGITTVLTMTTQSSGSRASLPKVSYVKAIDIWMAVCLLFVFAALLEYAAINFVSRQHKEFIRLRRRQRRQRLEEDIIQESRFYFRGYGLGHCLQARDGGPMEGSGIYSPQPPAPLLREGETTRKLYVD

SEQ ID NO: 47 - protein, 497 aa, Homo sapiens
MKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGIFSVLSLASECTTLAAELPKVSYVKALDVWLIACLLFGFASLVEYAVVQVMLNNPKRVEAEKARIAKAEQADGKGGNVAKKNTVNGTGTPVHISTLQVGETRCKKVCTSKSDLRSNDFSIVGSLPRDFELSNYDCYGKPIEVNNGLGKSQAKNNKKPPPAKPVIPTAAKRIDLYARALFPFCFLFFNVIYWSIYL

SEQ ID NO: 48 - protein, 399 aa, Homo sapiens
MARRFQEELAAFLFEYDTPRMVLVRNKKVGVIFRLIQLVVLVYVIGWVFLYEKGYQTSSGLISSVSVKLKGLAVTQLPGLGPQVWDVADYVFPAQGDNSFVVMTNFIVTPKQTQGYCAEHPEGGICKEDSGCTPGKAKRKAQGIRTGKCVAFNDTVKTCEIFGWCPVEVDDDIPRPALLREAENFTLFIKNSISFPRFKVNRRNLVEEVNAAHMKTCLFHKTLHPLCPVFQLGYVVQESGQNFSTLAEKGGVVGITIDWHCDLDWHVRHCRPIYEFHGLYEEKNLSPGFNFRFARHFVENGTNYRHLFKVFGIRFDILVDGKAGKFDIIPTMTTIGSGIGIFGVATVLCDLLLLHILPKRHYYKQKKFKYAEDMGPGAAERDLAATSSTLGLQENMRTS

SEQ ID NO: 49 - protein, 471 aa, Homo sapiens
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 50 - protein, 404 aa, Homo sapiens
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKMVDTPASEPAQASTPTDPKGLAQL

SEQ ID NO: 51 - protein, 447 aa, Homo sapiens
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 52 - protein, 497 aa, Homo sapiens
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVVRNPLWGPSGCGGSTRPLHTGLCWPQGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 53 - protein, 397 aa, Homo sapiens
MNCISDFFTYETTKSVVVKSWTIGIINRVVQLLIISYFVGWVFLHEKAYQVRDTAIESSVVTKVKGSGLYANRVMDVSDYVTPPQGTSVFVIITKMIVTENQMQGFCPESEEKYRCVSDSQCGPERLPGGGILTGRCVNYSSVLRTCEIQGWCPTEVDTVETPIMMEAENFTIFIKNSIRFPLFNFEKGNLLPNLTARDMKTCRFHPDKDPFCPILRVGDVVKFAGQDFAKLARTGGVLGIKIGWVCDLDKAWDQCIPKYSFTRLDSVSEKSSVSPGYNFRFAKYYKMENGSEYRTLLKAFGIRFDVLVYGNAGKFNIIPTIISSVAAFTSVGVGTVLCDIILLNFLKGADQYKAKKFEEVNETTLKIAALTNPVYPSDQTTAEKQSTDSGAFSIGH

SEQ ID NO: 54 - protein, 388 aa, Homo sapiens
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 55 - protein, 422 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 56 - protein, 441 aa, Homo sapiens
MCPQLAGAGSMGSPGATTGWGLLDYKTEKYVMTRNWRVGALQRLLQFGIVVYVVGWALLAKKGYQERDLEPQFSIITKLKGVSVTQIKELGNRLWDVADFVKPPQGENVFFLVTNFLVTPAQVQGRCPEHPSVPLANCWVDEDCPEGEGGTHSHGVKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 57 - protein, 595 aa, Homo sapiens
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTRNILPGLNITCTFHKTQNPQCPIFRLGDIFRETGDNFSDVAIQGGIMGIEIYWDCNLDRWFHHCRPKYSFRRLDDKTTNVSLYPGYNFRYAKYYKENNVEKRTLIKVFGIRFDILVFGTGGKFDIIQLVVYIGSTLSYFGLAAVFIDFLIDTYSSNCCRSHIYPWCKCCQPCVVNEYYYRKKCESIVEPKPTLKYVSFVDESHIRMVNQQLLGRSLQDVKGQEVPRPAMDFTDLSRLPLALHDTPPIPGQPEEIQLLRKEATPRSRDSPVWCQCGSCLPSQLPESHRCLEELCCRKKPGACITTSELFRKLVLSRHVLQFLLLYQEPLLALDVDSTNSRLRHCAYRCYATWRFGSQDMADFAILPSCCRWRIRKEFPKSEGQYSGFKSPY

SEQ ID NO: 58 - protein, 1009 aa, Homo sapiens
MEALTLWLLPWICQCVSVRADSIIHIGAIFEENAAKDDRVFQLAVSDLSLNDDILQSEKITYSIKVIEANNPFQAVQEACDLMTQGILALVTSTGCASANALQSLTDAMHIPHLFVQRNPGGSPRTACHLNPSPDGEAYTLASRPPVRLNDVMLRLVTELRWQKFVMFYDSEYDIRGLQSFLDQASRLGLDVSLQKVDKNISHVFTSLFTTMKTEELNRYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKAKKGNYAFLWDVAVVEYAALTDDDCSVTVIGNSISSKGYGIALQHGSPYRDLFSQRILELQDTGDLDVLKQKWWPHMGRCDLTSHASAQADGKSLKLHSFAGVFCILAIGLLLACLVAALELWWNSNRCHQETPKEDKEVNLEQVHRRMNSLMDEDIAHKQISPASIELSALEMGGLAPTQTLEPTREYQNTQLSVSTFLPEQSSHGTSRTLSSGPSSNLPLPLSSSATMPSMQCKHRSPNGGLFRQSPVKTPIPMSFQPVPGGVLPEALDTSHGTSI

SEQ ID NO: 59 - protein, 1007 aa, Homo sapiens
MEVFPFLLVLSVWWSRTWDSANADSIIHIGAIFDESAKKDDEVFRTAVGDLNQNEEILQTEKITFSVTFVDGNNPFQAVQEACELMNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPVPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRVVTVLEEPFVMVSENVLGKPKKYQGFSIDVLDALSNYLGFNYEIYVAPDHKYGSPQEDGTWNGLVGELVFKRADIGISALTITPDRENVVDFTTRYMDYSVGVLLRRAEKTVDMFACLAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDLSKQTEIPYGTVLDSAVYEHVRMKGLNPFERDSMYSQMWRMINRSNGSENNVLESQAGIQKVKYGNYAFVWDAAVLEYVAINDPDCSFYTIGNTVADRGYGIALQHGSPYRDVFSQRILELQQNGDMDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 60 - protein, 956 aa, Homo sapiens
MPRVSAPLVLLPAWLVMVACSPHSLRIAAILDDPMECSRGERLSITLAKNRINRAPERLGKAKVEVDIFELLRDSEYETAETMCQILPKGVVAVLGPSSSPASSSIISNICGEKEVPHFKVAPEEFVKFQFQRFTTLNLHPSNTDISVAVAGILNFFNCTTACLICAKAECLLNLEKLLRQFLISKDTLSVRMLDDTRDPTPLLKEIRDDKTATIIIHANASMSHTILLKAAELGMVSAYYTYIFTNLEFSLQRMDSLVDDRVNILGFSIFNQSHAFFQEFAQSLNQSWQENCDHVPFTGPALSSALLFDAVYAVVTAVQELNRSQEIGVKPLSCGSAQIWQHGTSLMNYLRMVELEGLTGHIEFNSKGQRSNYALKILQFTRNGFRQIGQWHVAEGLSMDSHLYASNISDTLFNTTLVVTTILENPYLMLKGNHQEMEGNDRYEGFCVDMLKELAEILRFNYKIRLVGDGVYGVPEANGTWTGMVGELIARKADLAVAGLTITAEREKVIDFSKPFMTLGISILYRVHMGRKPGYFSFLDPFSPGVWLFMLLAYLAVSCVLFLVARLTPYEWYSPHPCAQGRCNLLVNQYSLGNSLWFPVGGFMQQGSTIAPRALSTRCVSGVWWAFTLIIISSYTANLAAFLTVQRMDVPIESVDDLADQTAIEYGTIHGGSSMTFFQNSRYQTYQRMWNYMYSKQPSVFVKSTEEGIARVLNSNYAFLLESTMNEYYRQRNCNLTQIGGLLDTKGYGIGMPVGSVFRDEFDLAILQLQENNRLEILKRKWWEGGKCPKEEDHRAKGLGMENIGGIFVVLICGLIVAIFMAMLEFLWTLRHSEATEVSVCQEMVTELRSIILCQDSIHPRRRRAAVPPPRPPIPEERRPRGTATLSNGKLCGAGEPDQLAQRLAQEAALVARGCTHIRVCPECRRFQGLRARPSPARSEESLEWEKTTNSSEPE

SEQ ID NO: 61 - protein, 980 aa, Homo sapiens
MPAELLLLLIVAFASPSCQVLSSLRMAAILDDQTVCGRGERLALALAREQINGIIEVPAKARVEVDIFELQRDSQYETTDTMCQILPKGVVSVLGPSSSPASASTVSHICGEKEIPHIKVGPEETPRLQYLRFASVSLYPSNEDVSLAVSRILKSFNYPSASLICAKAECLLRLEELVRGFLISKETLSVRMLDDSRDPTPLLKEIRDDKVSTIIIDANASISHLILRKASELGMTSAFYKYILTTMDFPILHLDGIVEDSSNILGFSMFNTSHPFYPEFVRSLNMSWRENCEASTYLGPALSAALMFDAVHVVVSAVRELNRSQEIGVKPLACTSANIWPHGTSLMNYLRMVEYDGLTGRVEFNSKGQRTNYTLRILEKSRQGHREIGVWYSNRTLAMNATTLDINLSQTLANKTLVVTTILENPYVMRRPNFQALSGNERFEGFCVDMLRELAELLRFRYRLRLVEDGLYGAPEPNGSWTGMVGELINRKADLAVAAFTITAEREKVIDFSKPFMTLGISILYRVHMGRKPGYFSFLDPFSPAVWLFMLLAYLAVSCVLFLAARLSPYEWYNPHPCLRARPHILENQYTLGNSLWFPVGGFMQQGSEIMPRALSTRCVSGVWWAFTLIIISSYTANLAAFLTVQRMEVPVESADDLADQTNIEYGTIHAGSTMTFFQNSRYQTYQRMWNYMQSKQPSVFVKSTEEGIARVLNSRYAFLLESTMNEYHRRLNCNLTQIGGLLDTKGYGIGMPLGSPFRDEITLAILQLQENNRLEILKRKWWEGGRCPKEEDHRAKGLGMENIGGIFIVLICGLIIAVFVAVMEFIWSTRRSAESEEVSVCQEMLQELRHAVSCRKTSRSRRRRRPGGPSRALLSLRAVREMRLSNGKLYSAGAGGDAGSAHGGPQRLLDDPGPPSGARPAAPTPCTHVRVCQECRRIQALRASGAGAPPRGLGVPAEATSPPRPRPGPAGPRELAEHE

SEQ ID NO: 62 - protein, 938 aa, Homo sapiens
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 63 - protein, 1464 aa, Homo sapiens [sequence omitted]

SEQ ID NO: 64 - protein, 1484 aa, Homo sapiens [sequence omitted]

SEQ ID NO: 65 - protein, 1233 aa, Homo sapiens
MGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRGIYSCFSGVQSLASPPRQASPDLTASSAQASVLKMLQAARDMVTTAGVSSSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPELEDLPLLGPEQLARREALLHAAWARGSRPRHASLPSSVAEAFARPSSLPAGCTGPACARPDGHSACRRLAQAQSMCLPIYREACQEGEQAGAPAWQHRQHVCLHAHAHLPFCWGAVCPHLPPCASHGSWLSGAWGPLGHRGRTLGLGTGYRDSGGLDEISRVARGTQGFPGPCTWRRISSLESEV

SEQ ID NO: 66 - protein, 1336 aa, Homo sapiens
MRGAGGPRGPRGPAKMLLLLALACASPFPEEAPGPGGAGGPGGGLGGARPLNVALVFSGPAYAAEAARLGPAVAAAVRSPGLDVRPVALVLNGSDPRSLVLQLCDLLSGLRVHGVVFEDDSRAPAVAPILDFLSAQTSLPIVAVHGGAALVLTPKEKGSTFLQLGSSTEQQLQVIFEVLEEYDWTSFVAVTTRAPGHRAFLSYIEVLTDGSLVGWEHRGALTLDPGAGEAVLSAQLRSVSAQIRLLFCAREEAEPVFRAAEEAGLTGSGYVWFMVGPQLAGGGGSGAPGEPPLLPGGAPLPAGLFAVRSAGWRDDLARRVAAGVAVVARGAQALLRDYGFLPELGHDCRAQNRTHRGESLHRYFMNITWDNRDYSFNEDGFLVNPSLVVISLTRDRTWEVVGSWEQQTLRLKYPLWSRYGRFLQPVDDTQHLTVATLEERPFVIVEPADPISGTCIRDSVPCRSQLNRTHSPPPDAPRPEKRCCKGFCIDILKRLAHTIGFSYDLYLVTNGKHGKKIDGVWNGMIGEVFYQRADMAIGSLTINEERSEIVDFSVPFVETGISVMVARSNGTVSPSAFLEPYSPAVWVMMFVMCLTVVAVTVFIFEYLSPVGYNRSLATGKRPGGSTFTIGKSIWLLWALVFNNSVPVENPRGTTSKIMVLVWAFFAVIFLASYTANLAAFMIQEEYVDTVSGLSDRKFQRPQEQYPPLKFGTVPNGSTEKNIRSNYPDMHSYMVRYNQPRVEEALTQLKAGKLDAFIYDAAVLNYMARKDEGCKLVTIGSGKVFATTGYGIALHKGSRWKRPIDLALLQFLGDDEIEMLERLWLSGICHNDKIEVMSSKLDIDNMAGVFYMLLVAMGLSLLVFAWEHLVYWRLRHCLGPTHRMDFLLAFSRGMYSCCSAEAAPPPAKPPPPPQPLPSPAYPAPRPAPGPAPFVPRERASVDRWRRTKGAGPPGGAGLADGFHRYYGPIEPQGLGLGLGEARAAPRGAAGRPLSPPAAQPPQKPPPSYFAIVRDKEPAEPPAGAFPGFPSPPAPPAAAATAVGPPLCRLAFEDESPPAPARWPRSDPESQPLLGPGAGGAGGTGGAGGGAPAAPPPCRAAPPPCPYLDLEPSPSDSEDSESLGGASLGGLEPWWFADFPYPYAERLGPPPGRYWSVDKLGGWRAGSWDYLPPRSGPAAWHCRHCASLELLPPPRHLSCSHDGLDGGWWAPPPPPWAAGPLPRRRARCGCPRSHPHRPRASHRTPAAAAPHHHRHRRAAGGWDLPPPAPTSRSLEDLSSCPRAAPARRLTGPSRHARRCPHAAHWGPPLPTASHRRHRGGDLGTRRGSAHFSSLESEV

SEQ ID NO: 67 - protein, 1115 aa, Homo sapiens
MRRLSLWWLLSRVCLLLPPPCALVLAGVPSSSSHPQPCQILKRIGHAVRVGAVHLQPWTTAPRAASRAPDDSRAGAQRDEPEPGTRRSPAPSPGARWLGSTLHGRGPPGSRKPGEGARAEALWPRDALLFAVDNLNRVEGLLPYNLSLEVVMAIEAGLGDLPLLPFSSPSSPWSSDPFSFLQSVCHTVVVQGVSALLAFPQSQGEMMELDLVSLVLHIPVISIVRHEFPRESQNPLHLQLSLENSLSSDADVTVSILTMNNWYNFSLLLCQEDWNITDFLLLTQNNSKFHLGSIINITANLPSTQDLLSFLQIQLESIKNSTPTVVMFGCDMESIRRIFEITTQFGVMPPELRWVLGDSQNVEELRTEGLPLGLIAHGKTTQSVFEHYVQDAMELVARAVATATMIQPELALIPSTMNCMEVETTNLTSGQYLSRFLANTTFRGLSGSIRVKGSTIVSSENNFFIWNLQHDPMGKPMWTRLGSWQGGKIVMDYGIWPEQAQRHKTHFQHPSKLHLRVVTLIEHPFVFTREVDDEGLCPAGQLCLDPMTNDSSTLDSLFSSLHSSNDTVPIKFKKCCYGYCIDLLEKIAEDMNFDFDLYIVGDGKYGAWKNGHWTGLVGDLLRGTAHMAVTSFSINTARSQVIDFTSPFFSTSLGILVRTRDTAAPIGAFMWPLHWTMWLGIFVALHITAVFLTLYEWKSPFGLTPKGRNRSKVFSFSSALNICYALLFGRTVAIKPPKCWTGRFLMNLWAIFCMFCLSTYTANLAAVMVGEKIYEELSGIHDPKLHHPSQGFRFGTVRESSAEDYVRQSFPEMHEYMRRYNVPATPDGVEYLKNDPEKLDAFIMDKALLDYEVSIDADCKLLTVGKPFAIEGYGIGLPPNSPLTANISELISQYKSHGFMDMLHDKWYRVVPCGKRSFAVTETLQMGIKHFSGLFVLLCIGFGLSILTTIGEHIVYRLLLPRIKNKSKLQYWLHTSQRLHRAINTSFIEEKQQHFKTKRVEKRSNVGPRQLTVWNTSNLSHDNRRKYIFSDEEGQNQLGIRIHQDIPLPPRRRELPALRTTNGKADSLNVSRNSVMQELSELEKQIQVIRQELQLAVSRKTELEEYQRTSRTCES

SEQ ID NO: 68 - protein, 1043 aa, Homo sapiens
MEFVRALWLGLALALGPGSAGGHPQPCGVLARLGGSVRLGALLPRAPLARARARAALARAALAPRLPHNLSLELVVAAPPARDPASLTRGLCQALVPPGVAALLAFPEARPELLQLHFLAAATETPVLSLLRREARAPLGAPNPFHLQLHWASPLETLLDVLVAVLQAHAWEDVGLALCRTQDPGGLVALWTSRAGRPPQLVLDLSRRDTGDAGLRARLAPMAAPVGGEAPVPAAVLLGCDIARARRVLEAVPPGPHWLLGTPLPPKALPTAGLPPGLLALGEVARPPLEAAIHDIVQLVARALGSAAQVQPKRALLPAPVNCGDLQPAGPESPGRFLARFLANTSFQGRTGPVWVTGSSQVHMSRHFKVWSLRRDPRGAPAWATVGSWRDGQLDLEPGGASARPPPPQGAQVWPKLRVVTLLEHPFVFARDPDEDGQCPAGQLCLDPGTNDSATLDALFAALANGSAPRALRKCCYGYCIDLLERLAEDTPFDFELYLVGDGKYGALRDGRWTGLVGDLLAGRAHMAVTSFSINSARSQVVDFTSPFFSTSLGIMVRARDTASPIGAFMWPLHWSTWLGVFAALHLTALFLTVYEWRSPYGLTPRGRNRSTVFSYSSALNLCYAILFRRTVSSKTPKCPTGRLLMNLWAIFCLLVLSSYTANLAAVMVGDKTFEELSGIHDPKLHHPAQGFRFGTVWESSAEAYIKKSFPDMHAHMRRHSAPTTPRGVAMLTSDPPKLNAFIMDKSLLDYEVSIDADCKLLTVGKPFAIEGYGIGLPQNSPLTSNLSEFISRYKSSGFIDLLHDKWYKMVPCGKRVFAVTETLQMSIYHFAGLFVLLCLGLGSALLSSLGEHAFFRLALPRIRKGSRLQYWLHTSQKIHRALNTEPPEGSKEETAEAEPSGPEVEQQQQQQDQPTAPEGWKRARRAVDKERRVRFLLEPAVVVAPEADAEAEAAPREGPVWLCSYGRPPAARPTGAPQPGELQELERRIEVARERLRQALVRRGQLLAQLGDSARHRPRRLLQARAAPAEAPPHSGRPGSQE

SEQ ID NO: 69 - protein, 906 aa, Homo sapiens
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 70 - protein, 906 aa, Homo sapiens
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRGPVNLAVLKLSEQGVLDKLKSKWWYDKGECGSKDSGSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 71 - protein, 883 aa, Homo sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMRQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRTPVNLAVLKLSEQGVLDKLKNKWWYDKGECGAKDSGSKEKTSALSLSNVAGVFYILVGGLGLAMLVALIEFCYKSRAEAKRMKVAKNAQNINPSSSQNSQNFATYKEGYNVYGIESVKI

SEQ ID NO: 72 - protein, 883 aa, Homo sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMRQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKEKTSALSLSNVAGVFYILVGGLGLAMLVALIEFCYKSRAEAKRMKVAKNAQNINPSSSQNSQNFATYKEGYNVYGIESVKI

SEQ ID NO: 73 - protein, 894 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALGTPVNLAVLKLSEQGILDKLKNKWWYDKGECGAKDSGSKDKTSALSLSNVAGVFYILVGGLGLAMMVALIEFCYKSRAESKRMKLTKNTQNFKPAPATNTQNYATYREGYNVYGTESVKI

SEQ ID NO: 74 - protein, 894 aa, Homo sapiens
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALGNAVNLAVLKLNEQGLLDKLKNKWWYDKGECGSGGGDSKDKTSALSLSNVAGVFYILVGGLGLAMMVALIEFCYKSRAESKRMKLTKNTQNFKPAPATNTQNYATYREGYNVYGTESVKI

SEQ ID NO: 75 - protein, 902 aa, Homo sapiens
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNEYIEQRKPCDTMKVGGNLDSKGYGVATPKGSSLGTPVNLAVLKLSEAGVLDKLKNKWWYDKGECGPKDSGSKDKTSALSLSNVAGVFYILVGGLGLAMLVALIEFCYKSRAEAKRMKLTFSEAIRNKARLSITGSVGENGRVLTPDCPKAVHTGTAIRQSSGLAVIASDLP

SEQ ID NO: 76 - protein, 884 aa, Homo sapiens
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNEYIEQRKPCDTMKVGGNLDSKGYGVATPKGSSLGNAVNLAVLKLNEQGLLDKLKNKWWYDKGECGSGGGDSKDKTSALSLSNVAGVFYILVGGLGLAMLVALIEFCYKSRAEAKRMKVAKSAQTFNPTSSQNTQNLATYREGYNVYGTESIKI

SEQ ID NO: 77 - protein, 905 aa, Homo sapiens
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQCLSFNAIMEELGISLKNQKKIKKKSRTKGKSSFTSILTCHQRRTQRKETVA

SEQ ID NO: 78 - protein, 908 aa, Homo sapiens
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 79 - protein, 919 aa, Homo sapiens [sequence omitted]

SEQ ID NO: 80 - protein, 1998 aa, Homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 81 - protein, 1998 aa, Mus musculus
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCVQWPPTNASLEEHSIEKNITMDYNGTLVNETVFEFDWKSYIQDSRYHYFLEGVLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEAAQQAAATTASEHSREPSAAGRLSDSSSEASKLSSKSAKERRNRRKKRKQKEQSGGEEKDDDEFHKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEGTTTETEMRKRRSSSFHVSMDFLEDPSQRQRAMSIASILTNTVEELEESRQKCPPCWYKFSNIFLIWDCSPYWLKVKHIVNLVVMDPFVDLAITICIVLNTLFMAMEHYPMTEHFNHVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIATDCKLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGIAYVKRKIYEFIQQSFVKKQKILDEIKPLDDLNNRKDNCISNHTTEIGKDLDCLKDVNGTTSGIGTGSSVEKYIIDESDYMSFINNPSLTVTVPIAVGESDFENLNTEDFSSESDLEESKEKLNESSSSSEGSTVDIGAPAEEQPVIEPEETLEPEACFTEGCVQRFKCCQISVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCVNTTTGDIFEISEVNNHSDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSDYVTSILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKLKGGANLLVKEDMLIDRINENSITEKTDLTMSTAACPPSYDRVTKPIVEKHEQEGKDEKAKGK

SEQ ID NO: 82 - protein, 2009 aa, Mus musculus
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCVQWPPTNASLEEHSIEKNVTTDYNGTLVNETVFEFDWKSYIQDSRYHYFLEGVLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEAAQQAAAATASEHSREPSAAGRLSDSSSEASKLSSKSAKERRNRRKKRKQKEQSGGEEKDDDEFHKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAGLPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHIVNLVVMDPFVDLAITICIVLNTLFMAMEHYPMTEHFNHVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIATDCKLPRWHMNDFFHSFLIVFRVLCGEWIETMWDCMEVAGQAMCLTVFMMVMVIRNLVVLNLFLALLLSSFSADNLAATDDDNEMNNLQIAVDRMHKGVAYVKRKIYEFIQQSFVRKQKILDEIKPLDDLNNRKDNCTSNHTTEIGKDLDCLKDVNGTTSGIGTGSSVEKYIIDESDYMSFINNPSLTVTVPIAVGESDFENLNTEDFSSESDLEESKEKLNESSSSSEGSTVDIGAPAEEQPVMEPEETLEPEACFTEGCVQRFKCCQISVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCVNTTTGDTFEITEVNNHSDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSDYVTSILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKLKGGANLLVKEDMIIDRINENSITEKTDLTMSTAACPPSYDRVTKPIVEKHEQEGKDEKAKGK

SEQ ID NO: 83 - protein, 2005 aa, Homo sapiens
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 84 - protein, 2005 aa, Homo sapiens
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVNLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 85 - protein, 2006 aa, Mus musculus
MAQSVLVPPGPDSFRFFTRESLAAIEQRIAEEKAKRPKQERKDEDDENGPKPNSDLEAGKSLPFIYGDIPPEMVSEPLEDLDPYYINKKTFIVLNKGKAISRFSATSALYILTPFNPIRKLAIKILVHSLFNVLIMCTILTNCVFMTMSNPPDWTKNVEYTFTGIYTFESLIKILARGFCLEDFTFLRDPWNWLDFTVITFAYVTEFVNLGNVSALRTFRVLRALKTISVIPGLKTIVGALIQSVKKLSDVMILTVFCLSVFALIGLQLFMGNLRNKCLQWPPDNSTFEINITSFFNNSLDWNGTAFNRTMNMFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQAGEEEKEDAVRKSASEDSIRKKGFRFSLEGSRLTYEKRFSSPHQSLLSIRGSLFSPRRNSRASLFSFKGRVKDIGSENDFADDEHSTFEDNDSRRDSLFVPHRHGERRPSNVSQASRASRGIPTLPMNGKMHSAVDCNGVVSLVGGPSALTSPVGQLLPEGTTTETEIRKRRSSSYHVSMDLLEDPTSRQRAMSMASILTNTMEELEESRQKCPPCWYKFANMCLIWDCCKPWLKVKHVVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEAEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQMYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECQALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFCKLSDFAAALDPPLLIAKPNKVQLIAMDLPMVSGDRIHCLDILFAFTKRVLGESGEMDALRIQMEERFMASNPSKVSYEPITTTLKRKQEEVSAIVIQRAYRRYLLKQKVKKVSSIYKKDKGKEDEGTPIKEDIITDKLNENSTPEKTDVTPSTTSPPSYDSVTKPEKEKFEKDKSEKEDKGKDIRESKK

SEQ ID NO: 86 - protein, 2005 aa, Rattus norvegicus
MARSVLVPPGPDSFRFFTRESLAAIEQRIAEEKAKRPKQERKDEDDENGPKPNSDLEAGKSLPFIYGDIPPEMVSEPLEDLDPYYINKKTFIVLNKGKAISRFSATSALYILTPFNPIRKLAIKILVHSLFNVLIMCTILTNCVFMTMSNPPDWTKNVEYTFTGIYTFESLIKILARGFCLEDFTFLRNPWNWLDFTVITFAYVTEFVNLGNVSALRTFRVLRALKTISVIPGLKTIVGALIQSVKKLSDVMILTVFCLSVFALIGLQLFMGNLRNKCLQWPPDNSTFEINITSFFNNSLDWNGTAFNRTVNMFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQAGEEEKEDAVRKSASEDSIRKKGFQFSLEGSRLTYEKRFSSPHQSLLSIRGSLFSPRRNSRASLFNFKGRVKDIGSENDFADDEHSTFEDNDSRRDSLFVPHRHGERRPSNVSQASRASRGIPTLPMNGKMHSAVDCNGVVSLVGGPSALTSPVGQLLPEGTTTETEIRKRRSSSYHVSMDLLEDPSRQRAMSMASILTNTMEELEESRQKCPPCWYKFANMCLIWDCCKPWLKVKHVVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHHFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIALGESDFENLNTEEFSSESDMEESKEKLNATSSSEGSTVDIGAPAEGEQPEAEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQMYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECQALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPEKDHPGSSVKGDCGNPSVGIFFFVSYIIISFLVVVNMYIAVILENFSVATEESAEPLSEDDFEMFYEVWEKFDPDATQFIEFCKLSDFAAALDPPLLIAKPNKVQLIAMDLPMVSGDRIHCLDILFAFTKRVLGESGEMDALRIQMEERFMASNPSKVSYEPITTTLKRKQEEVSAIVIQRAYRRYLLKQKVKKVSSIYKKDKGKEDEGTPIKEDIITDKLNENSTPEKTDVTPSTTSPPSYDSVTKPEKEKFEKDKSEKEDKGKDIRESKK

SEQ ID NO: 87 - protein, 2000 aa, Homo sapiens
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVDLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 88 - protein, 1947 aa, Mus musculus
MAQALLVPPGPESFRLFTRESLAAIEKRAAEEKAKKPKKEQDIDDENKPKPNSDLEAGKNLPFIYGDIPPEMVSEPLEDLDPYYVSKKTFVVLNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVDLGNVSALRTFRVLRALKTISVIPGLKTIVGALIQSVKKLSDVMILTVFCLSVFALIGLQLFMGNLRNKCLQWPPSDSAFEINTTSYFNGTMDSNGTFVNVTMSTFNWKDYIADDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNHRPEGDRFPKSESEDSVKRRSFLFSLDGNPLSGDKKLCSPHQSLLSIRGSLFSPRRNSKTSIFSFRGRAKDVGSENDFADDEHSTFEDSESRRDSLFVPHRPGERRNSNGTTTETEVRKRRLSSYQISMEMLEDSSGRQRAMSIASILTNTMEELEESRQKCPPCWYRFANVFLIWDCCDSWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLANVEGLSVLRSFRLLRVFKLAKSWPTLNMLIKIIGNSVGALGNLTLVLAIIVFIFAVVGMQLFGKSYKECVCKINEDCKLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKIRECFRKAFFRKPKVIEIHEGNKIDSCMSNNTGVVEISKELNYLKDGNGTTSGVGTGSSVEKYVIDENDYMSFINNPSLTVTVPIAVGESDFENLNTEEFSSESELEESKEKLNATSSSEGSTVDVAPPREGEQAEIEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGSMFDMSEVNNFSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQSKYMTLVLSRINLVFIVLFTGEFLLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDAIHPGSSVKGDCGNPSVGIFFFVSYIIISFLVVVNMYIAVILENFSVATEESAEPLSEDDFEMFYEVWEKFDPDATQFIEFCKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNYRCYLLKQRLKNISNTYDKETIKGRIVLPIKGDMVIDKLNGNSTPEKTDGSSSTTSPPSYDSVTKPDKEKFEKDKPEKESKGKEV

SEQ ID NO: 89 - protein, 1951 aa, Rattus norvegicus
MAQALLVPPGPESFRLFTRESLAAIEKRAAEEKAKKPKKEQDIDDENKPKPNSDLEAGKNLPFIYGDIPPEMVSEPLEDLDPYYVSKKTFVVLNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVDLGNVSALRTFRVLRALKTISVIPGLKTIVGALIQSVKKLSDVMILTVFCLSVFALIGLQLFMGNLRNKCSQWPPSDSAFETNTTSYFNGTMDSNGTFVNVTMSTFNWKDYIADDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNHRADGDRFPKSESEDSVKRRSFLLSLDGNPLTGDKKLCSPHQSLLSIRGSLFSPRRNSKTSIFSFRGRAKDVGSENDFADDEHSTFEDSESRRDSLFVPHRPGERRNSNGTTTETEVRKRRLSSYQISMEMLEDSSGRQRSMSIASILTNTMEELEESRQKCPPCWYRFANVFLIWDCCDAWLKVKHLVNLIVMDPFVDLAITICIVLNTLFMAMEHYPMTQQFSSVLTVGNLVFTGIFTAEMVLKIIAMDPYYYFQEGWNIFDGIIVSLSLMELGLANVEGLSVLRSFRLLRVFKLAKSWPTLNMLIKIIGNSVGALGNLTLVLAIIVFIFAVVGMQLFGKSYKECVCKINVDCKLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDFVKNKIRECFRKAFFRKPKVIEIQEGNKIDSCMSNNTGIEISKELNYLKDGNGTTSGVGTGSSVEKYVIDENDYMSFINNPSLTVTVPIAVGESDFENLNTEEFSSESELEESKEKLNATSSSEGSTVDVAPPREGEQAEIEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNTTTGNMFEIKEVNNFSDCQALGKQARWKNVKVNFDNVGAGYLALLQVATFKGWMDIMYAAVDSRDVKLQPIYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQSKYMTLVLSRINLVFIVLFTGEFLLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDAIHPGSSVKGDCGNPSVGIFFFVSYIIISFLVVVNMYIAVILENFSVATEESAEPLSEDDFEMFYEVWEKFDPDATQFIEFCKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNYRCYLLKQRLKNISSKYDKETIKGRIDLPIKGDMVIDKLNGNSTPEKTDGSSSTTSPPSYDSVTKPDKEKFEKDKPEKEIKGKEVRENQK

SEQ ID NO: 90 - protein, 1836 aa, Homo sapiens
MARPSLCTLVPLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPEGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSSSGDSGISDAMEELEEAHQKCPPWWYKCAHKVLIWNCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEAGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKLGGKDIFMTEEQKKYYNAMKKLGSKKPQKPIPRPQNKIQGMVYDLVTKQAFDITIMILICLNMVTMMVETDNQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 91 - protein, 1841 aa, Mus musculus
MASSSLPTLVPPGPHCLRPFTPESLAAIEQRAMEEEARLQRNKQMEIEEPERKPRSDLEAGKNLPLIYGDPPPEVIGVPLEDLDPYYSDKKTFIVLNKGKAIFRFSATPALYMLSPFSIVRRVAIKVLIHALFSMFIMITILTNCVFMTMSNPPSWSKDVEYTFTGIYTFESLIKMLARGFCIDDFTFLRDPWNWLDFSVITMAYVTEFVDLGNISALRTFRVLRALKTITVIPGLKTIVGALIQSVKKLSDVMILTVFCLSVFALVGLQLFMGNLRQKCVRWPPPMNDTNTTWYGNDTWYGNDTWYGNDTWYGNDTWNSQESWVSNSTFDWEAYINDEGNFYFLEGSNDALLCGNSSDAGHCPEGYECMKAGRNPNYGYTSYDTFSWAFLALFRLMTQDYWENLFQLTLRAAGKTYMIFFVVIIFLGSFYLINLILAVVAMAYAEQNEATLAEDQEKEEEFQQMLEKFKKHQEELEKAKAAQALEGGEEADGDPTHSKDCNGSLDTSGEKGPPRPSCSAESAISDAMEELEEAHQKCPPWWYKCAHKVLIWNCCAPWVKFKHIILLIVMDPFVDLGITICIVLNTLFMAMEHYPMTEHFDNVLSVGNLVFTGIFTAEMVLKLIAMDPYEYFQQGWNIFDSFIVTLSLVELGLANVQGLSVLRSFRLLRVFKLAKSWPTLNMLIKIIGNSVGALGNLTLVLAIIVFIFAVVGMQLFGKSYKECVCKIASDCSLPRWHMHDFFHSFLIVFRILCGEWIETMWDCMEVAGQAMCLTVFLMVMVIGNLVVLNLFLALLLSSFSADSLAASDEDGEMNNLQIAIGRIKWGIAFAKTFLLGLLHGKILSLKDIMLSLGEPGGAGENGESPPEDEKKEPPPEDGNKELKDNHILNHVGLTDGPRSSIEMDHLNFINNPYLTIHVPIASEESDLEMPTEEETDTFSEPEDIKKPLQPLYDGNSSVCSTADYKPPEEDPEEQAEENPEGELPEECFTEACVKRCPCLYVDISQGRGKMWWTLRRACFKIVEHNWFETFIVFMILLSSGALAFEDIYIEQRRVIQTILEYADKVFTYIFILEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISVVNNKSECESLMYTGQVRWMNVKVNYDNVGLGYLSLLQVATFKGWMDIMYAAVDSREKEEQPDYEVNLYMYLYFVIFIIFGSFFTLNLFIGVIIDNFNQQKKKFGGKDIFMTEEQKKYYNAMKKLGSKKPQKPIPRPQNKIQGMVYDFVTKQVFDISIMILICLNMVTMMVETDDQSQLKVDILYNINMVFIIVFTGECVLKMFALRHYYFTIGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPTLENPGTNIKGDCGNPSIGICFFCSYIIISFLIVVNMYIAIILENFNVATEESSEPLCEDDFEMFYETWEKFDPDATQFIDYSRLSDFVDTLQEPLKIAKPNKIKLITLDLPMVPGDKIHCLDILFALTKEVLGDSGEMDALKQTMEEKFMAANPSKVSYEPITTTLKRKQEEVCAIKIQRAYRRHLLQRSVKQASYMYRHSQEGNGDGAPEKEGLLANTMNKMYGSEKEDNGVQSQGEKEKDSTEDAGPTTEVTAPSSSDTALTPPPPSPPPPSSPPQGQTVRPGVKESLV

SEQ ID NO: 92 - protein, 1840 aa, Rattus norvegicus
MASSSLPNLVPPGPHCLRPFTPESLAAIEQRAVEEEARLQRNKQMEIEEPERKPRSDLEAGKNLPLIYGDPPPEVIGIPLEDLDPYYSDKKTFIVLNKGKAIFRFSATPALYLLSPFSIVRRVAIKVLIHALFSMFIMITILTNCVFMTMSNPPSWSKHVEYTFTGIYTFESLIKMLARGFCIDDFTFLRDPWNWLDFSVITMAYVTEFVDLGNISALRTFRVLRALKTITVIPGLKTIVGALIQSVKKLSDVMILTVFCLSVFALVGLQLFMGNLRQKCVRWPPPMNDTNTTWYGNDTWYSNDTWYGNDTWYINDTWNSQESWAGNSTFDWEAYINDEGNFYFLEGSNDALLCGNSSDAGHCPEGYECIKAGRNPNYGYTSYDTFSWAFLALFRLMTQDYWENLFQLTLRAAGKTYMIFFVVIIFLGSFYLINLILAVVAMAYAEQNEATLAEDQEKEEEFQQMLEKYKKHQEELEKAKAAQALESGEEADGDPTHNKDCNGSLDASGEKGPPRPSCSADSAISDAMEELEEAHQKCPPWWYKCAHKVLIWNCCAPWVKFKHIIYLIVMDPFVDLGITICIVLNTLFMAMEHYPMTEHFDNVLSVGNLVFTGIFTAEMVLKLIAMDPYEYFQQGWNIFDSFIVTLSLVELGLANVQGLSVLRSFRLLRVFKLAKSWPTLNMLIKIIGNSVGALGNLTLVLAIIVFIFAVVGMQLFGKSYKECVCKIASDCNLPRWHMNDFFHSFLIVFRILCGEWIETMWDCMEVAGQAMCLTVFLMVMVIGNLVVLNLFLALLLSSFSADSLAASDEDGEMNNLQIAIGRIKWGIGFAKTFLLGLLRGKILSPKEIILSLGEPGGAGENAEESTPEDEKKEPPPEDKELKDNHILNHVGLTDGPRSSIELDHLNFINNPYLTIQVPIASEESDLEMPTEEETDAFSEPEDIKKPLQPLYDGNSSVCSTADYKPPEEDPEEQAEENPEGEQPEECFTEACVKRCPCLYVDISQGRGKMWWTLRRACFKIVEHNWFETFIVFMILLSSGALAFEDIYIEQRRVIRTILEYADKVFTYIFILEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCVNTTTSERFDISVVNNKSESESLMYTGQVRWMNVKVNYDNVGLGYLSLLQVATFKGWMDIMYAAVDSREKEEQPHYEVNLYMYLYFVIFIIFGSFFTLNLFIGVIIDNFNQQKKKFGGKDIFMTEEQKKYYNAMKKLGSKKPQKPIPRPQNKIQGMVYDFVTKQVFDISIMILICLNMVTMMVETDDQSQLKVDILYNINMVFIIIFTGECVLKMFALRHYYFTIGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPTLENPGTNVRGDCGNPSIGICFFCSYIIISFLIVVNMYIAIILENFNVATEESSEPLSEDDFEMFYETWEKFDPDATQFIDYSRLSDFVDTLQEPLKIAKPNKIKLITLDLPMVPGDKIHCLDILFALTKEVLGDSGEMDALKQTMEEKFMAANPSKVSYEPITTTLKRKQEEVCAIKIQRAYRRHLLQRSVKQASYMYRHSQDGNDDGAPEKEGLLANTMNKMYGHEKEGDGVQSQGEEEKASTEDAGPTVEPEPTSSSDTALTPSPPPLPPSSSPPQGQTVRPGVKESLV

SEQ ID NO: 93 - protein, 2016 aa, Homo sapiens
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYVSENIKLGNLSALRTFRVLRALKTISVIPGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQQESQPVSGGPEAPPDSRTWSQVSATASSEAEASASQADWRQQWKAEPQAPGCGETPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVATFKGWMDIMYAAVDSRGYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGECIVKLAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 94 - protein, 1998 aa, Homo sapiens
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYVSENIKLGNLSALRTFRVLRALKTISVIPGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQQESQPVSGGPEAPPDSRTWSQVSATASSEAEASASQADWRQQWKAEPQAPGCGETPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGECIVKLAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 95 - protein, 2015 aa, Homo sapiens [sequence omitted]

SEQ ID NO: 96 - protein, 2016 aa, Homo sapiens [sequence omitted]

SEQ ID NO: 97 - protein, 2020 aa, Mus musculus
MANFLLPRGTSSFRRFTRESLAAIEKRMAEKQARGSATSQESREGLPEEEAPRPQLDLQASKKLPDLYGNPPRELIGEPLEDLDPFYSTQKTFIVLNKGKTIFRFSATNALYVLSPFHPVRRAAVKILVHSLFSMLIMCTILTNCVFMAQHDPPPWTKYVEYTFTAIYTFESLVKILARGFCLHAFTFLRDPWNWLDFSVIVMAYVSENIKLGNLSALRTFRVLRALKTISVIPGLKTIVGALIQSVKKLADVMVLTVFCLSVFALIGLQLFMGNLRHKCVRNFTELNGTNGSVEADGIVWNSLDVYLNDPANYLLKNGTTDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVTNHERRSKRRKRLSSGTEDGGDDRLPKSDSEDGPRALNQLSLTHGLSRTSMRPRSSRGSIFTFRRRDQGSEADFADDENSTAGESESHRTSLLVPWPLRRPSTQGQPGFGTSAPGHVLNGKRNSTVDCNGVVSLLGAGDAEATSPGSHLLRPIVLDRPPDTTTPSEEPGGPQMLTPQAPCADGFEEPGARQRALSAVSVLTSALEELEESHRKCPPCWNRFAQHYLIWECCPLWMSIKQKVKFVVMDPFADLTITMCIVLNTLFMALEHYNMTAEFEEMLQVGNLVFTGIFTAEMTFKIIALDPYYYFQQGWNIFDSIIVILSLMELGLSRMGNLSVLRSFRLLRVFKLAKSWPTLNTLIKIIGNSVGALGNLTLVLAIIVFIFAVVGMQLFGKNYSELRHRISDSGLLPRWHMMDFFHAFLIIFRILCGEWIETMWDCMEVSGQSLCLLVFLLVMVIGNLVVLNLFLALLLSSFSADNLTAPDEDGEMNNLQLALARIQRGLRFVKRTTWDFCCGLLRRRPKKPAALATHSQLPSCIAAPRSPPPPEVEKAPPARKETRFEEDKRPGQGTPGDTEPVCVPIAVAESDTDDQEEDEENSLGTEEEESSKQQESQVVSGGHEPPQEPRAWSQVSETTSSEAEASTSQADWQQEREAEPRAPGCGETPEDSYSEGSTADMTNTADLLEQIPDLGEDVKDPEDCFTEGCVRRCPCCMVDTTQAPGKVWWRLRKTCYRIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSECESFNVTGELYWTKVKVNFDNVGAGYLALLQVATFKGWMDIMYAAVDSRGYEEQPQWEDNLYMYIYFVVFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKVNILAKINLLFVAIFTGECIVKMAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPNLPNSNGSRGNCGSPAVGILFFTTYIIISFLIVVNMYIAIILENFSVATEESTEPLSEDDFDMFYEIWEKFDPEATQFIEYLALSDFADALSEPLRIAKPNQISLINMDLPMVSGDRIHCMDILFAFTKRVLGESGEMDALKIQMEEKFMAANPSKISYEPITTTLRRKHEEVSATVIQRAFRRHLLQRSVKHASFLFRQQAGSSGLSDEDAPEREGLIAYMMNENFSRRSGPLSSSSISSTSFPPSYDSVTRATSDNLPVRASDYSRSEDLADFPPSPDRDRESIV

SEQ ID NO: 98 - protein, 2019 aa, Rattus norvegicus
MANLLLPRGTSSFRRFTRESLAAIEKRMAEKQARGGSATSQESREGLQEEEAPRPQLDLQASKKLPDLYGNPPRELIGEPLEDLDPFYSTQKTFIVLNKGKTIFRFSATNALYVLSPFHPVRRAAVKILVHSLFSMLIMCTILTNCVFMAQHDPPPWTKYVEYTFTAIYTFESLVKILARGFCLHAFTFLRDPWNWLDFSVIVMAYTTEFVDLGNVSALRTFRVLRALKTISVISGLKTIVGALIQSVKKLADVMVLTVFCLSVFALIGLQLFMGNLRHKCVRNFTELNGTNGSVEADGLVWNSLDVYLNDPANYLLKNGTTDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVTNHERKSKRRKRLSSGTEDGGDDRLPKSDSEDGPRALNQLSLTHGLSRTSMRPRSSRGSIFTFRRRDQGSEADFADDENSTAGESESHRTSLLVPWPLRHPSAQGQPGPGASAPGYVLNGKRNSTVDCNGVVSLLGAGDAEATSPGSYLLRPMVLDRPPDTTTPSEEPGGPQMLTPQAPCADGFEEPGARQRALSAVSVLTSALEELEESHRKCPPCWNRFAQHYLIWECCPLWMSIKQKVKFVVMDPFADLTITMCIVLNTLFMALEHYNMTAEFEEMLQVGNLVFTGIFTAEMTFKIIALDPYYYFQQGWNIFDSIIVILSLMELGLSRMGNLSVLRSFRLLRVFKLAKSWPTLNTLIKIIGNSVGALGNLTLVLAIIVFIFAVVGMQLFGKNYSELRHRISDSGLLPRWHMMDFFHAFLIIFRILCGEWIETMWDCMEVSGQSLCLLVFLLVMVIGNLVVLNLFLALLLSSFSADNLTAPDEDGEMNNLQLALARIQRGLRFVKRTTWDFCCGILRRRPKKPAALATHSQLPSCITAPRSPPPPEVEKVPPARKETRFEEDKRPGQGTPGDSEPVCVPIAVAESDTEDQEEDEENSLGTEEESSKQESQVVSGGHEPYQEPRAWSQVSETTSSEAGASTSQADWQQEQKTEPQAPGCGETPEDSYSEGSTADMTNTADLLEQIPDLGEDVKDPEDCFTEGCVRRCPCCMVDTTQSPGKVWWRLRKTCYRIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSECESFNVTGELYWTKVKVNFDNVGAGYLALLQVATFKGWMDIMYAAVDSRGYEEQPQWEDNLYMYIYFVVFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKVNILAKINLLFVAIFTGECIVKMAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPNLPNSNGSRGNCGSPAVGILFFTTYIIISFLIVVNMYIAIILENFSVATEESTEPLSEDDFDMFYEIWEKFDPEATQFIEYLALSDFADALSEPLRIAKPNQISLINMDLPMVSGDRIHCMDILFAFTKRVLGESGEMDALKIQMEEKFMAANPSKISYEPITTTLRRKHEEVSATVIQRAFRRHLLQRSVKHASFLFRQQAGGSGLSDEDAPEREGLIAYMMNGNFSRRSAPLSSSSISSTSFPPSYDSVTRATSDNLPVRASDYSRSEDLADFPPSPDRDRESIV

SEQ ID NO: 99 - protein, 1980 aa, Homo sapiens
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 100 - protein, 1978 aa, Mus musculus
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPEWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTRGFDWEEYINNKTNFYMVPGMLEPLLCGNSSDAGQCPEGFQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEDGVGSPRSSSELSKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQCSRSSRIFPSLRRSVKRNSTVDCNGVVSLIGPGSHIGRLLPEATTEVEIKKKGPGSLLVSMEQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELGLADVEGLSVLRSFRLLRVFKLAKSWPTLNMLIKIIGNSVGALGNLTLVLAIIVFIFAVVGMQLFGKSYKECVCKISQECKLPRWHMNDFFHSFLIVFRVLCGEWIETMWDCMEVAGQAMCLIVFMMVMVIGNLVVLNLFLALLLSSFSADNLAATDDDGEMNNLQISVIRIKKGVAWAKVKVHAFMQAHFKQREADEVKPLDELYEKKANCIANHTGVDIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIDEVNNKTDCEKLMEGNNTEIRWKNVKINFDNVGAGYLALLQVATFKGWMDIMYAAVDSRKPDEQPDYEGNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICRKITSNKLENGGTHREKKESTPSTASLPSYDSVTKPDKEKQQRAEEGRRERAKRQKEVRESKC

SEQ ID NO: 101 - protein, 1978 aa, Rattus norvegicus
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPEWSKNVEYTFTGIYTFESLVKIIARGFCIDGFTFLRDPWNWLDFSVIMMAYVTEFVDLGNVSALRTFRVLRALKTISVIPGLKTIVGALIQSVKKLSDVMILTVFCLSVFALIGLQLFMGNLRNKCVVWPINFNESYLENGTRGFDWEEYINNKTNFYMVPGMLEPLLCGNSSDAGQCPEGFQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEDGVGSPRSSSELSKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQCSRSSRIFPSLRRSVKRNSTVDCNGVVSLIGPGSHIGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQECKLPRWHMNDFFHSFLIVFRVLCGEWIETMWDCMEVAGQAMCLIVFMMVMVIGNLVVLNLFLALLLSSFSADNLAATDDDGEMNNLQISVIRIKKGVAWTKVKVHAFMQAHFKQREADEVKPLDELYEKKANCIANHTGVDIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIDIVNNKTDCEKLMEGNSTEIRWKNVKINFDNVGAGYLALLQVATFKGWMDIMYAAVDSRKPDEQPDYEGNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICRKMASNKLENGGTHRDKKESTPSTASLPSYDSVTKPDKEKQQRAEEGRRERAKRQKEVRESKC

SEQ ID NO: 102 - protein, 1977 aa, Homo sapiens
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVRRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 103 - protein, 1975 aa, Mus musculus
MAMLPPPGPQSFVHFTKQSLALIEQRISEEKAKGHKDEKKDDEEEGPKPSSDLEAGKQLPFIYGDIPPGMVSEPLEDLDPYYADKKTFIVLNKGKAIFRFNATPALYMLSPFSPLRRISIKILVHSLFSMLIMCTILTNCIFMTMSNPPDWTKNVEYTFTGIYTFESLIKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRKDLEQNETLENGHKGYQRKCKVKTMGYFYYLEGSKDALLCGFSTDSGQCPEGYECVTAGRNPDYGYTSFDTFGWAFLALFRLMTQDYWENLYQQTLRAAGKTYMIFFVVVIFLGSFYLINLILAVVAMAYEEQNQANIEEAKQKELEFQQMLDRLKKEQEEAEVVFIITNTKAKQVGQRIMGLSESSSETSRLSSKSAKERRNRRKKKKQKLSSGEEKGDDEKLSKSGSEESIRKKSFHLGVEGHHRAREKRLSTPNQSPLSIRGSLFSARRSSRTSLFSFKGRGRDLGSETEFADDEHSIFGDNESRRGSLFVPHRPRERRSSNISQASRSPPVLPVNGKMHSAVDCNGVVSLVDGPSALMLPNGQLLPEGTTNQMRKKRLSSSYFLSEDMLNDPHLRQRAMSRASILTNTVEELEESRQKCPPWWYRFAHTFLIWNCSPYWIKFKKFIYFIVMDPFVDLAITICIVLNTLFMAMEHHPMTDEFKNVLAVGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINENCKLPRWHMNDFFHSFLIVFRVLCGEWIETMWDCMEVAGQTMCLIVYMMVMVIGNLVVLNLFLALLLSSFSSDNLTAIEEDTDANNLQIAVARIKRGINYVKQTLREFILKSFSKKPKGSKDTKRTADPNNKRENYISNRTLAEISKDHNFLKEKDKISGFSSSLDKSFMDENDYQSFIHNPSLTVTVPIAPGESDLENMNTEELSSDSDSDYSKERRNRSSSSECSTVDNPLPGEEEAEAEPINADEPEACFTDGCVRRFPCCQVNIDSGKGKVWWTIRKTCYRIVEHSWFESFIVLMILLSSGALAFEDIYIEKKKTIKIILEYADKIFTYIFILEMLLKWVAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECVNTTDGSRFSVSQVANRSECFALMNVSGNVRWKNLKVNFDNVGLGYLSLLQVATFKGWMDIMYAAVDSVNVNAQPIYEYNLYMYIYFVIFIIFGSFFTLNLFIGVIIDNFNQQKKKLGGQDIFMTEEQKKYYNAMKKLGSKKPQKPIPRPGNKFQGCIFDLVTNQAFDITIMVLICLNMVTMMVEKEGQTDYMSFVLYWINVVFIILFTGECVLKLISLRHYYFTVGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGINDMFNFETFGNSMICLFQITTSAGWDGLLAPILNSAPPDCDPKKVHPGSSVEGDCGNPSVGIFYFVSYIIISFLVVVNMYIAVILENFSVATEESTEPLSEDDFEMFYEVWEKFDPDATQFIEFCKLSDFAAALDPPLLIAKPNKVQLIAMDLPMVSGDRIHCLDILFAFTKRVLGESGEMDSLRSQMEERFMSANPSKVSYEPITTTLKRKQEDVSATIIQRAYRRYRLRQNVKNISSIYIKDGDRDDDLPNKEDIVFDNVNENSSPEKTDATASTISPPSYDSVTKPDQEKYETDKTEKEDKEKDESRK

SEQ ID NO: 104 - protein, 1984 aa, Rattus norvegicus
MAMLPPPGPQSFVHFTKQSLALIEQRISEEKAKEHKDEKKDDEEEGPKPSSDLEAGKQLPFIYGDIPPGMVSEPLEDLDPYYADKKTFIVLNKGKAIFRFNATPALYMLSPFSPLRRISIKILVHSLFSMLIMCTILTNCIFMTLSNPPEWTKNVEYTFTGIYTFESLIKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRKELEENETLESIMNTAESEEELKKYFYYLEGSKDALLCGFSTDSGQCPEGYICVKAGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEFTSIGRSRIMGLSESSSETSRLSSKSAKERRNRRKKKKQKMSSGEEKGDDEKLSKSGSEESIRKKSFHLGVEGHHRTREKRLSTPNQSPLSIRGSLFSARRSSRTSLFSFKGRGRDLGSETEFADDEHSIFGDNESRRGSLFVPHRPRERRSSNISQASRSPPVLPVNGKMHSAVDCNGVVSLVDGPSALMLPNGQLLPEVIIDKATSDDSGTTNQMRKKRLSSSYFLSEDMLNDPHLRQRAMSRASILTNTVEELEESRQKCPPWWYRFAHTFLIWNCSPYWIKFKKLIYFIVMDPFVDLAITICIVLNTLFMAMEHHPMTEEFKNVLAVGNLIFTGIFAAEMVLKLIAMDPYEYFQVGWNIFDSLIVTLSLIELFLADVEGLSVLRSFRLLRVFKLAKSWPTLNMLIKIIGNSVGALGNLTLVLAIIVFIFAVVGMQLFGKSYKECVCKINVDCKLPRWHMNDFFHSFLIVFRVLCGEWIETMWDCMEVAGQTMCLIVYMMVMVIGNLVVLNLFLALLLSSFSSDNLTAIEEDTDANNLQIAVARIKRGINYVKQTLREFILKSFSKKPKGSKDTKRTADPNNKKENYISNRTLAEMSKDHNFLKEKDRISGYGSSLDKSFMDENDYQSFIHNPSLTVTVPIAPGESDLEIMNTEELSSDSDSDYSKEKRNRSSSSECSTVDNPLPGEEEAEAEPVNADEPEACFTDGCVRRFPCCQVNVDSGKGKVWWTIRKTCYRIVEHSWFESFIVLMILLSSGALAFEDIYIEKKKTIKIILEYADKIFTYIFILEMLLKWVAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECVNTTDGSRFPTSQVANRSECFALMNVSGNVRWKNLKVNFDNVGLGYLSLLQVATFKGWMDIMYAAVDSVNVNEQPKYEYSLYMYIYFVIFIIFGSFFTLNLFIGVIIDNFNQQKKKLGGQDIFMTEEQKKYYNAMKKLGSKKPQKPIPRPGNKFQGCIFDLVTNQAFDITIMVLICLNMVTMMVEKEGQTEYMDYVLHWINMVFIILFTGECVLKLISLRHYYFTVGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGINDMFNFETFGNSMICLFQITTSAGWDGLLAPILNSAPPDCDPKKVHPGSSVEGDCGNPSVGIFYFVSYIIISFLVVVNMYIAVILENFSVATEESTEPLSEDDFEMFYEVWEKFDPDATQFIEFCKLSDFAAALDPPLLIAKPNKVQLIAMDLPMVSGDRIHCLDILFAFTKRVLGEGGEMDSLRSQMEERFMSANPSKVSYEPITTTLKRKQEEVSATIIQRAYRRYRLRQHVKNISSIYIKDGDRDDDLPNKEDTVFDNVNENSSPEKTDVTASTISPPSYDSVTKPDQEKYETDKTEKEDKEKDESRK

SEQ ID NO: 105 - protein, 1956 aa, Homo sapiens
MEFPIGSLETNNFRRFTPESLVEIEKQIAAKQGTKKAREKHREQKDQEEKPRPQLDLKACNQLPKFYGELPAELIGEPLEDLDPFYSTHRTFMVLNKGRTISRFSATRALWLFSPFNLIRRTAIKVSVHSWFSLFITVTILVNCVCMTRTDLPEKIEYVFTVIYTFEALIKILARGFCLNEFTYLRDPWNWLDFSVITLAYVGTAIDLRGISGLRTFRVLRALKTVSVIPGLKVIVGALIHSVKKLADVTILTIFCLSVFALVGLQLFKGNLKNKCVKNDMAVNETTNYSSHRKPDIYINKRGTSDPLLCGNGSDSGHCPDGYICLKTSDNPDFNYTSFDSFAWAFLSLFRLMTQDSWERLYQQTLRTSGKIYMIFFVLVIFLGSFYLVNLILAVVTMAYEEQNQATTDEIEAKEKKFQEALEMLRKEQEVLAALGIDTTSLHSHNGSPLTSKNASERRHRIKPRVSEGSTEDNKSPRSDPYNQRRMSFLGLASGKRRASHGSVFHFRSPGRDISLPEGVTDDGVFPGDHESHRGSLLLGGGAGQQGPLPRSPLPQPSNPDSRHGEDEHQPPPTSELAPGAVDVSAFDAGQKKTFLSAEYLDEPFRAQRAMSVVSIITSVLEELEESEQKCPPCLTSLSQKYLIWDCCPMWVKLKTILFGLVTDPFAELTITLCIVVNTIFMAMEHHGMSPTFEAMLQIGNIVFTIFFTAEMVFKIIAFDPYYYFQKKWNIFDCIIVTVSLLELGVAKKGSLSVLRSFRLLRVFKLAKSWPTLNTLIKIIGNSVGALGNLTIILAIIVFVFALVGKQLLGENYRNNRKNISAPHEDWPRWHMHDFFHSFLIVFRILCGEWIENMWACMEVGQKSICLILFLTVMVLGNLVVLNLFIALLLNSFSADNLTAPEDDGEVNNLQVALARIQVFGHRTKQALCSFFSRSCPFPQPKAEPELVVKLPLSSSKAENHIAANTARGSSGGLQAPRGPRDEHSDFIANPTVWVSVPIAEGESDLDDLEDDGGEDAQSFQQEVIPKGQQEQLQQVERCGDHLTPRSPGTGTSSEDLAPSLGETWKDESVPQVPAEGVDDTSSSEGSTVDCLDPEEILRKIPELADDLEEPDDCFTEGCIRHCPCCKLDTTKSPWDVGWQVRKTCYRIVEHSWFESFIIFMILLSSGSLAFEDYYLDQKPTVKALLEYTDRVFTFIFVFEMLLKWVAYGFKKYFTNAWCWLDFLIVNISLISLTAKILEYSEVAPIKALRTLRALRPLRALSRFEGMRVVVDALVGAIPSIMNVLLVCLIFWLIFSIMGVNLFAGKFWRCINYTDGEFSLVPLSIVNNKSDCKIQNSTGSFFWVNVKVNFDNVAMGYLALLQVATFKGWMDIMYAAVDSREVNMQPKWEDNVYMYLYFVIFIIFGGFFTLNLFVGVIIDNFNQQKKKLGGQDIFMTEEQKKYYNAMKKLGSKKPQKPIPRPLNKFQGFVFDIVTRQAFDITIMVLICLNMITMMVETDDQSEEKTKILGKINQFFVAVFTGECVMKMFALRQYYFTNGWNVFDFIVVVLSIASLIFSAILKSLQSYFSPTLFRVIRLARIGRILRLIRAAKGIRTLLFALMMSLPALFNIGLLLFLVMFIYSIFGMSSFPHVRWEAGIDDMFNFQTFANSMLCLFQITTSAGWDGLLSPILNTGPPYCDPNLPNSNGTRGDCGSPAVGIIFFTTYIIISFLIMVNMYIAVILENFNVATEESTEPLSEDDFDMFYETWEKFDPEATQFITFSALSDFADTLSGPLRIPKPNRNILIQMDLPLVPGDKIHCLDILFAFTKNVLGESGELDSLKANMEEKFMATNLSKSSYEPIATTLRWKQEDISATVIQKAYRSYVLHRSMALSNTPCVPRAEEEAASLPDEGFVAFTANENCVLPDKSETASATSFPPSYESVTRGLSDRVNMRTSSSIQNEDEATSMELIAPGP

SEQ ID NO: 106 - protein, 1957 aa, Mus musculus
MEFPFGSVGTTNFRRFTPESLAEIEKQIAAHRAAKKGRPKQRGQKDKSEKPRPQLDLKACNQLPRFYGELPAELVGEPLEDLDPFYSTHRTFIVLDKSRTISRFSATWALWLFSPFNLIRRTAIKVSVHSWFSIFITVTILVNCVCMTRTDLPEKLEYAFTVVYTFEALIKILARGFCLNEFTYLRDPWNWLDFSVITLAYVGAAIDLRGISGLRTFRVLRALKTVSVIPGLKVIVGALIHSVRKLADVTILTVFCLSVFALVGLQLFKGNLKNKCIKNGTDPHKADNLSSEMAGDIFIKPGTTDPLLCGNGSDAGHCPNDYVCRKTSDNPDFNYTSFDSFAWAFLSLFRLMTQDSWERLYQQTLRASGKMYMVFFVLVIFLGSFYLVNLILAVVTMAYEEQSQATIAEIEAKEKKFKEALEVLQKEQEVLAALGIDTTSLYSHNGSPLAPKNANERRPRVKSRMSEGSTDDNRSLQSDPYNQRRMSFLGLSSGRRRASHSSVFHFRAPSQDVSFPDGILDDGVFHGDQESRRSSILLGRGAGQAGPLPRSPLPQSPNPGPRRGEEGQRGVPTGELATGAPEGPALDAAGQKNFLSADYLNEPFRAQRAMSVVSIMTSVIEELEESKLKCPPCLISLAQKYLIWECCPKWKKFKMVLFELVTDPFAELTITLCIVVNTVFMAMEHYPMTDAFDAMLQAGNIVFTVFFTMEMAFKIIAFDPYYYFQKKWNIFDCVIVTVSLLELSTSKKGSLSVLRTFRLLRVFKLAKSWPTLNMLIKIIGNSVGALGNLTFILAIIVFIFALVGKQLLSENYGCRRDGISVWNGERLRWHMCDFFHSFLVVFRILCGEWIENMWVCMEVSQDYICLTLFLTVMVLGNLVVLNLFIALLLNSFSADNLTAPEDDGEVNNLQVALARIQVFGHRASRAITSYIRSHCRLRWPKVETQLGMKPPLTSCKAENHIATDAVNAAVGNLAKPALGGPKENHGDFITDPNVWVSVPIAEGESDLDELEEDVEHASQSSWQEESPKGQELLQQVQKCEDHQAARSPPSGMSSEDLAPYLGERWQREESPRVPAEGVDDTSSSEGSTVDCPDPEEILRKIPELAEELDEPDDCFPEGCTRRCPCCKVNTSKFPWATGWQVRKTCYRIVEHSWFESFIIFMILLSSGALAFEDNYLEEKPRVKSVLEYTDRVFTFIFVFEMLLKWVAYGFKKYFTNAWCWLDFLIVNISLTSLIAKILEYSDVASIKALRTLRALRPLRALSRFEGMRVVVDALVGAIPSIMNVLLVCLIFWLIFSIMGVNLFAGKFSRCVDTRSNPFSVVNSTFVTNKSDCYNQNNTGHFFWVNVKVNFDNVAMGYLALLQVATFKGWMDIMYAAVDSRDINSQPNWEESLYMYLYFVVFIIFGGFFTLNLFVGVIIDNFNQQKKKLGGQDIFMTEEQKKYYNAMKKLGSKKPQKPIPRPLNKYQGFVFDIVTRQAFDIIIMALICLNMITMMVETDNQSEEKTKVLGRINQFFVAVFTGECVMKMFALRQYYFTNGWNVFDFIVVILSISSLLFSAILSSLESYFSPTLLRVIRLARIGRILRLIRAAKGIRTLLFALMMSLPALFNIGLLLFLVMFIYSIFGMASFANVIDEAGIDDMFNFKTFGNSMLCLFQITTSAGWDGLLSPILNTGPPYCDPNRPNSNGSKGNCGSPAVGILFFTTYIIISFLIVVNMYIAVILENFNVATEESTEPLSEDDFDMFYETWEKFDPEATQFIAFSALSDFADTLSGPLRIPKPNQNILIQMDLPLVPGDKIHCLDILFAFTKNVLGESGELDSLKTNMEEKFMATNLSKASYEPIATTLRCKQEDISATIIQKAYRNYMLQRSLMLSNPLHVPRAEEDGVSLPREGYVTFMANDNGGLPDKSETASATSFPPSYDSVTRGLSDRANISTSSSMQNEDEVTAKEGKSPGPQ

SEQ ID NO: 107 - protein, 1957 aa, Rattus norvegicus
MELPFASVGTTNFRRFTPESLAEIEKQIAAHRAAKKARTKHRGQEDKGEKPRPQLDLKDCNQLPKFYGELPAELVGEPLEDLDPFYSTHRTFMVLNKSRTISRFSATWALWLFSPFNLIRRTAIKVSVHSWFSIFITITILVNCVCMTRTDLPEKVEYVFTVIYTFEALIKILARGFCLNEFTYLRDPWNWLDFSVITLAYVGAAIDLRGISGLRTFRVLRALKTVSVIPGLKVIVGALIHSVRKLADVTILTVFCLSVFALVGLQLFKGNLKNKCIRNGTDPHKADNLSSEMAEYIFIKPGTTDPLLCGNGSDAGHCPGGYVCLKTPDNPDFNYTSFDSFAWAFLSLFRLMTQDSWERLYQQTLRASGKMYMVFFVLVIFLGSFYLVNLILAVVTMAYEEQSQATIAEIEAKEKKFQEALEVLQKEQEVLEALGIDTTSLQSHSGSPLASKNANERRPRVKSRVSEGSTDDNRSPQSDPYNQRRMSFLGLSSGRRRASHGSVFHFRAPSQDISFPDGITPDDGVFHGDQESRRGSILLGRGAGQTGPLPRSPLPQSPNPGRRHGEEGQLGVPTGELTAGAPEGPALHTTGQKSFLSAGYLNEPFRAQRAMSVVSIMTSVIEELEESKLKCPPCLISFAQKYLIWECCPKWRKFKMALFELVTDPFAELTITLCIVVNTVFMAMEHYPMTDAFDAMLQAGNIVFTVFFTMEMAFKIIAFDPYYYFQKKWNIFDCVIVTVSLLELSASKKGSLSVLRTLRLLRVFKLAKSWPTLNTLIKIIGNSVGALGNLTFILAIIVFIFALVGKQLLSEDYGCRKDGVSVWNGEKLRWHMCDFFHSFLVVFRILCGEWIENMWVCMEVSQKSICLILFLTVMVLGNLVVLNLFIALLLNSFSADNLTAPEDDGEVNNLQLALARIQVLGHRASRAIASYISSHCRFHWPKVETQLGMKPPLTSSEAKNHIATDAVSAAVGNLTKPALSSPKENHGDFITDPNVWVSVPIAEGESDLDELEEDMEQASQSSWQEEDPKGQQEQLPQVQKCENHQAARSPASMMSSEDLAPYLGESWKRKDSPQVPAEGVDDTSSSEGSTVDCPDPEEILRKIPELADDLDEPDDCFTEGCTRRCPCCNVNTSKSPWATGWQVRKTCYRIVEHSWFESFIIFMILLSSGALAFEDNYLEEKPRVKSVLEYTDRVFTFIFVFEMLLKWVAYGFKKYFTNAWCWLDFLIVNISLTSLIAKILEYSDVASIKALRTLRALRPLRALSRFEGMRVVVDALVGAIPSIMNVLLVCLIFWLIFSIMGVNLFAGKFSKCVDTRNNPFSNVNSTMVNNKSECHNQNSTGHFFWVNVKVNFDNVAMGYLALLQVATFKGWMDIMYAAVDSGEINSQPNWENNLYMYLYFVVFIIFGGFFTLNLFVGVIIDNFNQQKKKLGGQDIFMTEEQKKYYNAMKKLGSKKPQKPIPRPLNKYQGFVFDIVTRQAFDIIIMVLICLNMITMMVETDEQGEEKTKVLGRINQFFVAVFTGECVMKMFALRQYYFTNGWNVFDFIVVILSIGSLLFSAILKSLENYFSPTLFRVIRLARIGRILRLIRAAKGIRTLLFALMMSLPALFNIGLLLFLVMFIYSIFGMASFANVVDEAGIDDMFNFKTFGNSMLCLFQITTSAGWDGLLSPILNTGPPYCDPNLPNSNGSRGNCGSPAVGIIFFTTYIIISFLIVVNMYIAVILENFNVATEESTEPLSEDDFDMFYETWEKFDPEATQFIAFSALSDFADTLSGPLRIPKPNQNILIQMDLPLVPGDKIHCLDILFAFTKNVLGESGELDSLKTNMEEKFMATNLSKASYEPIATTLRWKQEDLSATVIQKAYRSYMLHRSLTLSNTLHVPRAEEDGVSLPGEGYITFMANSGLPDKSETASATSFPPSYDSVTRGLSDRANINPSSSMQNEDEVAAKEGNSPGPQ

SEQ ID NO: 108 - protein, 1791 aa, Homo sapiens
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSTMISTLENQEHIPFPPTLFRIVRLARIGRILRLVRAARGIRTLLFALMMSLPSLFNIGLLLFLIMFIYAILGMNWFSKVNPESGIDDIFNFKTFASSMLCLFQISTSAGWDSLLSPMLRSKESCNSSSENCHLPGIATSYFVSYIIISFLIVVNMYIAVILENFNTATEESEDPLGEDDFDIFYEVWEKFDPEATQFIKYSALSDFADALPEPLRVAKPNKYQFLVMDLPMVSEDRLHCMDILFAFTARVLGGSDGLDSMKAMMEEKFMEANPLKKLYEPIVTTTKRKEEERGAAIIQKAFRKYMMKVTKGDQGDQNDLENGPHSPLQTLCNGDLSSFGVAKGKVHCD

SEQ ID NO: 109 - protein, 1765 aa, Mus musculus
MEERYYPVIFPDERNFRPFTFDSLAAIEKRITIQKEKKKSKDKAATEPQPRPQLDLKASRKLPKLYGDVPPDLIAKPLEDLDPFYKDHKTFMVLNKKRTIYRFSAKRALFILGPFNPIRSFMIRISVHSVFSMFIICTVIINCMFMANNSSVDSRPSSNIPEYVFIGIYVLEAVIKILARGFIVDEFSYLRDPWNWLDFIVIGTAIAPCFLGNKVNNLSTLRTFRVLRALKAISVISGLKVIVGALLRSVKKLVDVMVLTLFCLSIFALVGQQLFMGILSQKCIKDDCGPNAFSNKDCFVKENDSEDFIMCGNWLGRRSCPDGSTCNKTTFNPDYNYTNFDSFGWSFLAMFRVMTQDSWEKLYRQILRTSGIYFVFFFVVVIFLGSFYLLNLTLAVVTMAYEEQNRNVAAETEAKEKMFQEAQQLLREEKEALVAMGIDRTSLNSLQASSFSPKKRKFFGSKTRKSFFMRGSKTARASASDSEDDASKNPQLLEQTKRLSQNLPVELFDEHVDPLHRQRALSAVSILTITMQEQEKSQEPCFPCGKNLASKYLVWECSPPWLCIKKVLQTIMTDPFTELAITICIIVNTVFLAMEHHNMDNSLKDILKIGNWVFTGIFIAEMCLKIIALDPYHYFRHGWNIFDSIVALVSLADVLFHKLSKNLSFLASLRVLRVFKLAKSWPTLNTLIKIIGHSVGALGNLTVVLTIVVFIFSVVGMRLFGAKFNKTCSTSPESLRRWHMGDFYHSFLVVFRILCGEWIENMWECMQEMEGSPLCVIVFVLIMVVGKLVVLNLFIALLLNSFSNEEKDGNPEGETRKTKVQLALDRFSRAFYFMARALQNFCCKRCRRQNSPKPNEATESFAGESRDTATLDTRSWKEYDSEMTLYTGQAGAPLAPLAKEEDDMECCGECDASPTSQPSEEAQACDLPLKTKRLPSPDDHGVEMEVFSEEDPNLTIQSARKKSDAASMLSECSTIDLNDIFRNLQKTVSPQKQPDRCFPKGLSCIFLCCKTIKKKSPWVLWWNLRKTCYQIVKHSWFESFIIFVILLSSGALIFEDVNLPSRPQVEKLLKCTDNIFTFIFLLEMILKWVAFGFRKYFTSAWCWLDFLIVVVSGLSLTNLPNLKSFRNLRALRPLRALSQFEGMKVVVNALMSAIPAILNVLLVCLIFWLIFCILGVNFFSGKFGRCINGTDINKYFNASNVPNQSQCLVSNYTWKVPNVNFDNVGNAYLALLQVATYKGWLDIMNAAVDSRGKDEQPAFEANLYAYLYFVVFIIFGSFFTLNLFIGVIIDNFNQQQKKLGGQDIFMTEEQKKYYNAMKKLGTKKPQKPIPRPLNKCQAFVFDLVTSQVFDVIILGLIVTNMIIMMAESEGQPNEVKKIFDILNIVFVVIFTVECLIKVFALRQHYFTNGWNLFDCVVVVLSIISTLVSGLENSNVFPPTLFRIVRLARIGRILRLVRAARGIRTLLFALMMSLPSLFNIGLLLFLVMFIYAIFGMNWFSKVKRGSGIDDIFNFDTFSGSMLCLFQITTSAGWDALLNPMLESKASCNSSSQESCQQPQIAIVYFVSYIIISFLIVVNMYIAVILENFNTATEESEDPLGEDDFEIFYEIWEKFDPEATQFIQYSSLSDFADALPEPLRVAKPNRFQFLMMDLPMVMGDRLHCMDVLFAFTTRVLGNSSGLDTMKAMMEEKFMEANPFKKLYEPIVTTTKRKEEEECAAVIQRAYRRHMEKMIKLKLKGRSSSSLQVFCNGDLSSLDVPKIKVHCD

SEQ ID NO: 110 - protein, 1765 aa, Rattus norvegicus
MEERYYPVIFPDERNFRPFTSDSLAAIEKRIAIQKERKKSKDKAAAEPQPRPQLDLKASRKLPKLYGDIPPELVAKPLEDLDPFYKDHKTFMVLNKKRTIYRFSAKRALFILGPFNPLRSLMIRISVHSVFSMFIICTVIINCMFMANSMERSFDNDIPEYVFIGIYILEAVIKILARGFIVDEFSFLRDPWNWLDFIVIGTAIATCFPGSQVNLSALRTFRVFRALKAISVISGLKVIVGALLRSVKKLVDVMVLTLFCLSIFALVGQQLFMGILNQKCIKHNCGPNPASNKDCFEKEKDSEDFIMCGTWLGSRPCPNGSTCDKTTLNPDNNYTKFDNFGWSFLAMFRVMTQDSWERLYRQILRTSGIYFVFFFVVVIFLGSFYLLNLTLAVVTMAYEEQNRNVAAETEAKEKMFQEAQQLLREEKEALVAMGIDRSSLNSLQASSFSPKKRKFFGSKTRKSFFMRGSKTAQASASDSEDDASKNPQLLEQTKRLSQNLPVDLFDEHVDPLHRQRALSAVSILTITMQEQEKFQEPCFPCGKNLASKYLVWDCSPQWLCIKKVLRTIMTDPFTELAITICIIINTVFLAVEHHNMDDNLKTILKIGNWVFTGIFIAEMCLKIIALDPYHYFRHGWNVFDSIVALLSLADVLYNTLSDNNRSFLASLRVLRVFKLAKSWPTLNTLIKIIGHSVGALGNLTVVLTIVVFIFSVVGMRLFGTKFNKTAYATQERPRRRWHMDNFYHSFLVVFRILCGEWIENMWGCMQDMDGSPLCIIVFVLIMVIGKLVVLNLFIALLLNSFSNEEKDGSLEGETRKTKVQLALDRFRRAFSFMLHALQSFCCKKCRRKNSPKPKETTESFAGENKDSILPDARPWKEYDTDMALYTGQAGAPLAPLAEVEDDVEYCGEGGALPTSQHSAGVQAGDLPPETKQLTSPDDQGVEMEVFSEEDLHLSIQSPRKKSDAVSMLSECSTIDLNDIFRNLQKTVSPKKQPDRCFPKGLSCHFLCHKTDKRKSPWVLWWNIRKTCYQIVKHSWFESFIIFVILLSSGALIFEDVNLPSRPQVEKLLRCTDNIFTFIFLLEMILKWVAFGFRRYFTSAWCWLDFLIVVVSVLSLMNLPSLKSFRTLRALRPLRALSQFEGMKVVVYALISAIPAILNVLLVCLIFWLVFCILGVNLFSGKFGRCINGTDINMYLDFTEVPNRSQCNISNYSWKVPQVNFDNVGNAYLALLQVATYKGWLEIMNAAVDSREKDEQPDFEANLYAYLYFVVFIIFGSFFTLNLFIGVIIDNFNQQQKKLGGQDIFMTEEQKKYYNAMKKLGTKKPQKPIPRPLNKCQAFVFDLVTSQVFDVIILGLIVLNMIIMMAESADQPKDVKKTFDILNIAFVVIFTIECLIKVFALRQHYFTNGWNLFDCVVVVLSIISTLVSRLEDSDISFPPTLFRVVRLARIGRILRLVRAARGIRTLLFALMMSLPSLFNIGLLLFLVMFIYAIFGMSWFSKVKKGSGIDDIFNFETFTGSMLCLFQITTSAGWDTLLNPMLEAKEHCNSSSQDSCQQPQIAVVYFVSYIIISFLIVVNMYIAVILENFNTATEESEDPLGEDDFEIFYEVWEKFDPEASQFIQYSALSDFADALPEPLRVAKPNKFQFLVMDLPMVMGDRLHCMDVLFAFTTRVLGDSSGLDTMKTMMEEKFMEANPFKKLYEPIVTTTKRKEEEQGAAVIQRAYRKHMEKMVKLRLKDRSSSSHQVFCNGDLSSLDVAKVKVHND

SEQ ID NO: 111 - protein, 1873 aa, Homo sapiens
MEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGWPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPLWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFALLGMQLFGGRYDFEDTEVRRSNFDNFPQALISVFQVLTGEDWTSMMYNGIMAYGGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVVQCMFVAISTIGNIVLVTTLLQFMFACIGVQLFKGKFFRCTDLSKMTEEECRGYYYVYKDGDPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGDPWNVFDFLIVIGSIIDVILSEIDTFLASSGGLYCLGGGCGNVDPDESARISSAFFRLFRVMRLIKLLSRAEGVRTLLWTFIKSFQALPYVALLIVMLFFIYAVIGMQMFGKIALVDGTQINRNNNFQTFPQAVLLLFRCATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYGNSNHSNSHVFSSVHYEREFPEETETPATRGRALGQPCRVLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALADACQMEPEEVEIMATELLKGREAPEGMASSLGCLNLGSSLGSLDQHQGSQETLIPPRL

SEQ ID NO: 112 - protein, 1852 aa, Mus musculus
MEPPSPQDEGLRKKQPKKPVPEILPRPPRALFCLTLQNPLRKACISIVEWKPFETIILLTIFANCVALAVYLPMPEDDNNTLNLGLEKLEYFFLIVFSIEAAMKIIAYGFLFHQDAYLRSGWNVLDFIIVFLGVFTVILEQVNIIQTNTAPMSSKGAGLDVKALRAFRVLRPLRLVSGVPSLQVVLNSIFKAMLPLFHIALLVLFMVIIYAIIGLELFKGKMHKTCYFIGTDIVATVENEKPSPCARTGSGRPCTINGSECRGGWPGPNHGITHFDNFGFSMLTVYQCISMEGWTDVLYWVNDAIGNEWPWIYFVTLILLGSFFILNLVLGVLSGEFTKEREKAKSRGTFQKLREKQQLEEDLRGYMSWITQGEVMDVDDLREGKLSLDEGGSDTESLYEIEGLNKIIQFIRHWRQWNRVFRWKCHDLVKSKVFYWLVILIVALNTLSIASEHHNQPLWLTHLQDVANRVLLTLFTIEMLMKMYGLGLRQYFMSIFNRFDCFVVCSGILEILLVESGAMSPLGISVLRCIRLLRLFKITKYWTSLSNLVASLLNSIRSIASLLLLLFLFIIIFALLGMQLFGGRYDFEDTEVRRSNFDNFPQALISVFQVLTGEDWNSVMYNGIMAYGGPTYPGVLVCIYFIILFVCGNYILLNVFLAIAVDNLAEAESLTSAQKAKAEERKRRKMSKGLPDKSEEERATVTKKLEQKSKGEGIPTTAKLKIDEFESNVNEVKDPYPSADFPGDDEEDEPEIPVSPRPRPLAELQLKEKAVPIPEASSFFIFSPTNKIRVLCHRIVNATWFTNFILLFILLSSAALAAEDPIRADSMRNQILEYFDYVFTAVFTVEIVLKMTTYGAFLHKGSFCRNYFNILDLLVVAVSLISMGLESSAISVVKILRVLRVLRPLRAINRAKGLKHVVQCVFVAIRTIGNIVLVTTLLQFMFACIGVQLFKGKFYSCNDLSKMTEEECRGYYYIYKDGDPTQIELRPRQWIHNDFHFDNVLSAMMSLFTVSTFEGWPQLLYKAIDSNEEDTGPVYNNRVEMAIFFIIYIILIAFFMMNIFVGFVIVTFQEQGETEYKNCELDKNQRQCVQYALKARPLRCYIPKNPYQYQVWYVVTSSYFEYLMFALIMLNTICLGMQHYNQSEQMNHISDILNVAFTIIFTLEMVLKLIAFKPRGYFGDPWNVFDFLIVIGSIIDVILSEIDTFLASSGGLYCLGGGCGNVDPDESARISSAFFRLFRVMRLVKLLNRAEGVRTLLWTFIKSFQALPYVALLIVMLFFIYAVIGMQMFGKIAMVDGTQINRNNNFQTFPQAVLLLFRCATGEAWQEILLACSYGKLCDPESDYAPGEEHTCGTNFAYYYFISFYMLCAFLIINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDTVQIQAGLRTIEEEAAPEIHRAISGDLTAEEELERAMVEAAMEEGIFRRTGGLFGQVDNFLERTNSLPPVMANQRPLQFAEIEMEELESPVFLEDFPQNPGTHPLARANTNNANANVAYGNSSHRNNPVFSSICYEREFLGEADMPVTREGPLSQPCRASGPHSRSHVDKLKRPMTQRGMPEGQVPPSPCQVTGAKAEHPVQKEGKGPTSRFLETPNSRNFEEHVPRNSAHRCTAPATAMLIQEALVRGGLDSLAADANFVMATGQALADACQMEPEEVEVAATELLKQESPEGGAVPWEP

SEQ ID NO: 113 - protein, 1850 aa, Rattus norvegicus
MEPSSPQDEGLRKKQPKKPVPEILPRPPRALFCLTLQNPLRKACISVVEWKPFETIILLTIFANCVALAVYLPMPEDDNNTLNLGLEKLEYFFLIVFSIEAAMKIIAYGFLFHQDAYLRSGWNVLDFIIVFLGVFTAILEQVNIIQTNTAPMSSKGAGLDVKALRAFRVLRPLRLVSGVPSLQVVLNSIFKAMLPLFHIALLVLFMVIIYAIIGLELFKGKMHKTCYFIGTDIVATVENEKPSPCARTGSGRPCTINGSECRGGWPGPNHGITHFDNFGFSMLTVYQCISMEGWTDVLYWVNDAIGNEWPWIYFVTLILLGSFFILNLVLGVLSGEFTKEREKAKSRGTFQKLREKQQLEEDLRGYMSWITQGEVMDVDDLREGKLSLDEGGSDTESLYEIEGLNKIIQFIRHWRQWNRVFRWKCHDLVKSKVFYWLVILIVALNTLSIASEHHNQPLWLTHLQDVANRVLLALFTIEMLMKMYGLGLRQYFMSIFNRFDCFVVCSGILEILLVESGAMTPLGISVLRCIRLLRLFKITKYWTSLSNLVASLLNSIRSIASLLLLLFLFMIIFALLGMQLFGGRYDFEDTEVRRSNFDNFPQALISVFQVLTGEDWNSVMYNGIMAYGGPSYPGVLVCIYFIILFVCGNYILLNVFLAIAVDNLAEAESLTSAQKAKAEERKRRKMSRGLPDKSEEERSTMTKKLEQKPKGEGIPTTAKLKIDEFESNVNEVKDPYPSADFPGDDEEDEPEIPASPRPRPLAELQLKEKAVPIPEASSFFIFSPTNKIRVLCHRIVNATWFTNFILLFILLSSAALAAEDPIRADSMRNQILEYFDYVFTAVFTVEIVLKMTTYGAFLHKGSFCRNYFNILDLLVVAVSLISMGLESSAISVVKILRVLRVLRPLRAINRAKGLKHVVQCVFVAIRTIGNIVLVTTLLQFMFACIGVQLFKGKFYSCNDLSKMTEEECRGYYYIYKDGDPTQIELRPRQWIHNDFHFDNVLSAMMSLFTVSTFEGWPQLLYKAIDSNEEDTGPVYNNRVEMAIFFIIYIILIAFFMMNIFVGFVIVTFQEQGETEYKNCELDKNQRQCVQYALKARPLRCYIPKNPYQYQVWYVVTSSYFEYLMFALIMLNTICLGMQHYNQSEQMNHISDILNVAFTIIFTLEMILKLIAFKPRGYFGDPWNVFDFLIVIGSIIDVILSEIDTLLASSGGLYCLGGGCGNVDPDESARISSAFFRLFRVMRLIKLLSRAEGVRTLLWTFIKSFQALPYVALLIVMLFFIYAVIGMQMFGKIAMVDGTQINRNNNFQTFPQAVLLLFRCATGEAWQEILLACSYGKRCDPESDYAPGEEYACGTNFAYYYFISFYMLCAFLIINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDTVQIQAGLRTIEEEAAPEIHRAISGDLTAEEELERAMVEAAMEEGIFRRTGGLFGQVDNFLERTNSLPPVMANQRPLQFAEMEMEELESPVFLEDFPQNPGTHPLARANTNNANANVAYGNSSHRNSPVFSSIRYERELLEEAGRPVTREGPFSQPCSVSGVNSRSHVDKLERQMSQRRMPKGQVPPSPCQLSQEKHPVHEEGKGPRSWSTETSDSESFEERVPRNSAHKCTAPATTMLIQEALVRGGLDSLAADANFVMATGQALADACQMEPEEVEVAATELLKRESPKGGAMPREP

SEQ ID NO: 114 - protein, 2138 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 115 - protein, 2169 aa, Mus musculus
MIRAFVQPSTPPYQPLSSHSSEETERKFKGKVVHEAQLNCFYISPGGSNYGSPRPAHANMNANAAAGLAPEHIPTPGAALSWQAAIDAARQAKLMGSAGNATISTVSSTQRKRQQYGKPKKQGGTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIIDVPAEEDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEDKPRNMSMPTSETESVNTENVAGGDIEGENCGARLAHRISKSKFSRYWRRWNRFCRRKCRAAVKSNVFYWLVIFLVFLNTLTIASEHYNQPHWLTEVQDTANKALLALFTAEMLLKMYSLGLQAYFVSLFNRFDCFIVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQEVMEKPAVEESKEEKIELKSITADGESPPTTKINMDDLQPSENEDKSPHSNPDTAGEEDEEEPEMPVGPRPRPLSELHLKEKAVPMPEASAFFIFSPNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMSAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVTYYQSDSRGNFPQTFATQRPLHINKTGNNQADTESPSHEKLVDSTFTPSSYSSTGSNANINNANNTALGRFPHPAGYSSTVSTVEGHGPPLSPAVRVQEAAWKLSSKRCHSRESQGATVNQEIFPDETRSVRMSEEAEYCSEPSLLSTDMFSYQEDEHRQLTCPEEDKREIQPSPKRSFLRSASLGRRASFHLECLKRQKDQGGDISQKTALPLHLVHHQALAVAGLSPLLQRSHSPTTFPRPCPTPPVTPGSRGRPLRPIPTLRLEGAESSEKLNSSFPSIHCSSWSEETTACSGSSSMARRARPVSLTVPSQAGAPGRQFHGSASSLVEAVLISEGLGQFAQDPKFIEVTTQELADACDMTIEEMENAADNILSGGAQQSPNGTLLPFVNCRDPGQDRAVAPEDESCAYALGRGRSEEALADSRSYVSNL

SEQ ID NO: 116 - protein, 2170 aa, Rattus norvegicus
MIRAFAQPSTPPYQPLSSCLSEDTERKFKGKVVHEAQLNCFYISPGGSNYGSPRPAHANMNANAAAGLAPEHIPTPGAALSWQAAIDAARQAKLMGSAGNATISTVSSTQRKRQQYGKPKKQGGTTATRPPRALLCLTLKNPIRRACISIVEWKSFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIIDVPAEEDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEDKPRNMSMPTSETESVNTENVAGGDIEGENCGARLAHRISKSKFSRYWRRWNRFCRRKCRAAVKSNVFYWLVIFLVFLNTLTIASEHYNQPHWLTEVQDTANKALLALFTAEMLLKMYSLGLQAYFVSLFNRFDCFIVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQEVMEKPAVEESKEEKIELKSITADGESPPTTKINMDDLQPSENEDKSPHSNPDTAGEEDEEEPEMPVGPRPRPLSELHLKEKAVPMPEASAFFIFSPNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVHPAEHTQCSPSMSAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDSRSNFPQTFATQRPLHINKTGNNQADTESPSHEKLVDSTFTPSSYSSTGSNANINNANNTALGRFPHPAGYSSTVSTVEGHGPPLSPAVRVQEAAWKLSSKRCHSRESQGATVSQDMFPDETRSSVRLSEEVEYCSEPSLLSTDILSYQDDENRQLTCLEEDKREIQPSPKRSFLRSASLGRRASFHLECLKRQKDQGGDISQKTALPLHLVHHQALAVAGLSPLLQRSHSPSTFPRPRPTPPVTPGSRGRPLQPIPTLRLEGAESSEKLNSSFPSIHCSSWSEETTACSGGSSMARRARPVSLTVPSQAGAPGRQFHGSASSLVEAVLISEGLGQFAQDPKFIEVTTQELADACDMTIEEMENAADNILSGGAQQSPNGTLLPFVNCRDPGQDRAVVPEDESCVYALGRGRSEEALPDSRSYVSNL

SEQ ID NO: 117 - protein, 2181 aa, Homo sapiens
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLWCWWRRRGAAKAGPSGCRRWGQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 118 - protein, 2166 aa, Mus musculus
MNLPTFSSDLILIKSVLSQETDARYKGRVVSAVESTEDFSQAFAEANYARGTRLPISGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGETQGCCGTLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELELMSPLGVSVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYQEDAEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENVGPVYNYRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPDSDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEDSKPEEEDVFKRNGALLGNHVNHVNSDRRDSLQQTNTTHRPLHVQRPSMPPASDTEKPLFPPAGNSGCHNHHNHNSIGKQAPTSTNANLNNANMSKAAHGKPPSIGNLEHVSENGHYSCKHDRELQRRSSIKRTRYYETYIRSESGDEQFPTICREDPEIHGYFRDPRCLGEQEYFSSEECCEDDSSPTWSRQNYNYYNRYPGSSMDFERPRGYHHPQGFLEDDDSPTGYDSRRSPRRRLLPPTPPSHRRSSFNFECLRRQSSQDDVLPSPALPHRAALPLHLMQQQIMAVAGLDSSKAQKYSPSHSTRSWATPPATPPYRDWSPCYTPLIQVDRSESMDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGSVCPRANGDMGPISHRQDYELQDFGPGYSDEEPDPGREEEDLADEMICITTL

SEQ ID NO: 119 - protein, 2203 aa, Rattus norvegicus
MMMMMMMKKMQHQRQQQEDHANEANYARGTRLPISGEGPTSQPNSSKQTVLSWQAAIDAARQAKAAQTMSTSAPPPVGSLSQRKRQQYAKSKKQGNSSNSRPARALFCLSLNNPIRRACISIVDWKPFDIFILLAIFANCVALAIYIPFPEDDSNSTNHNLEKVEYAFLIIFTVETFLKIIASGLLLHPNASVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCAANGTECRSGWVGPNGGITNFDNFAFAMLTVFQCITMEGWTDVLYWVNDAIGWEWPWVYFVSLIILGSFFVLNLVLGVLSGEFSKEREKAKARGDFQKLREKQQLEEDLKGYLDWITQAEDIDPENEEEGGEEGKRNTSMPTSETESVNTENVSGEGETQGCCGSLWCWWKRRGAAKTGPSGCRRWGQAISKSKLRSHGAREALCVCRCSLESLVKLWTSRFSAHLQAAYVRPYSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELELMSPLGVSVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLKLFLAIAVDNLADAESLNTAQKEEAEEKERKKIARKESLENKKNNKPEVNQIANSDNKVTIDDYQEEAEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENVGPVYNYRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPDSDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEDSKPEEEDVFKRNGALLGNYVNHVNSDRRESLQQTNTTHRPLHVQRPSIPPASDTEKPLFPPAGNSVCHNHHNHNSIGKQVPTSTNANLNNANMSKAAHGKRPSIGDLEHVSENGHYSYKHDRELQRRSSIKRTRYYETYIRSESGDEQLPTIFREDPEIHGYFRDPRCFGEQEYFSSEECCEDDSSPTWSRQNYSYYNRYPGSSMDFERPRGYHHPQGFLEDDDSPIGYDSRRSPRRRLLPPTPPSHRRSSFNFECLRRQNSQDDVLPSPALPHRAALPLHLMQQQIMAVAGLDSSKAQKYSPSHSTRSWATPPATPPYRDWTPCYTPLIQVDRSESMDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGSVCPRANGDMGPISHRQDYELQDFGPGYSDEEPDPGREEEDLADEMICITTL

SEQ ID NO: 120 - protein, 1977 aa, Homo sapiens
MSESEGGKDTTPEPSPANGAGPGPEWGLCPGPPAVEGESSGASGLGTPKRRNQHSKHKTVAVASAQRSPRALFCLTLANPLRRSCISIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGSMAEEGRAGHRPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 121 - protein, 1984 aa, Mus musculus
MSESEVGKDTTPEPSPANGTGPGPEWGLCPGPPTVGTDTSGASGLGTPRRRTQHNKHKTVAVASAQRSPRALFCLTLTNPIRRSCISIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRSCTLNHTECRGRWPGPNGGITNFDNFFFAMLTVFQCITMEGWTDVLYWMQDAMGYELPWVYFVSLVIFGSFFVLNLVLGVLSGEFSKEREKAKARGDFQKLREKQQMEEDLRGYLDWITQAEELDLHDPSVDGNLASLAEEGRAGHRPQLSELTNRRRGRLRWFSHSTRSTHSTSSHASLPASDTGSMTDTPGDEDEEEGTMASCTRCLNKIMKTRICRHFRRANRGLRARCRRAVKSNACYWAVLLLVFLNTLTIASEHHGQPLWLTQTQEYANKVLLCLFTVEMLLKLYGLGPSVYVASFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCVYFIILFICGNYILLNVFLAIAVDNLASGDAGTAKDKGREKSSEGNPPKENKVLVPGGENEDAKGARSEGAAPGMEEEEEEEEEEEEEEEEENGAGHVELLQEVVPKEKVVPIPEGSAFFCLSQTNPLRKACHTLIHHHIFTSLILVFIILSSVSLAAEDPIRAHSFRNHILGYFDYAFTSIFTVEILLKMTVFGAFLHRGSFCRSWFNLLDLLVVSVSLISFGIHSSAISVVKILRVLRVLRPLRAINRAKGLKHVVQCVFVAIRTIGNIMIVTTLLQFMFACIGVQLFKGKFYSCTDEAKHTLKECKGSFLIYPDGDVSRPLVRERLWVNSDFNFDNVLSAMMALFTVSTFEGWPALLYKAIDANAEDEGPIYNYHVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFADAWNTFDALIVVGSVVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSSFAIVYFISFFMLCAFLIINLFVAVIMDNFDYLTRDWSILGPHHLDEFKRIWSEYDPGAKGRIKHLDVVALLRRIQPPLGFGKLCPHRVACKRLVAMNVPLNSDGTVTFNATLFALVRTSLKIKTEGNLDQANQELRMVIKKIWKRIKQKLLDEVIPPPDEEEVTVGKFYATFLIQDYFRKFRRRKEKGLLGREAPTSTSSALQAGLRSLQDLGPEIRQALTYDTEEEEEEEEAVGQEAEEEEAENNPEPYKDSIDSQPQSRWNSRISVSLPVKEKLPDSLSTGPSDDDGLAPNSRQPSVIQAGSQPHRRSSGVFMFTIPEEGSIQLKGTQGQDNQNEEQEVPDWTPDLDEQAGTPSNPVLLPPHWSQQHVNGHHVPRRRLLPPTPAGRKPSFTIQCLQRQGSCEDLPIPGTYHRGRTSGPSRAQGSWAAPPQKGRLLYAPLLLVEESTVGEGYLGKLGGPLRTFTCLQVPGAHPNPSHRKRGSADSLVEAVLISEGLGLFAQDPRFVALAKQEIADACHLTLDEMDSAASDLLAQRTTSLYSDEESILSRFDEEDLGDEMACVHAL

SEQ ID NO: 122 - protein, 1981 aa, Rattus norvegicus
MSESEVGKDTTPEPSPANGTGPGPEWGLCPGPPTVGTDTSGASGLGTPRRRTQHNKHKTVVVASAQRSPRALFCLTLTNPIRRSCISIVEWKPFDILILLTIFANCVALGVYIPFPEDDSNTATHNLEQVEYVFLVIFTVKTVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRSCTLNQTECRGRWPGPNGGITNFDNFFFAMLTVFQCITMEGWTDVLYWMQDAMGYELPWVYFVSLVIFGSFFVLNLVLGVLSGEFSKEREKAKARGDFQKLREKQQMEEDLRGYLDWITQAEELDLHDPSVDGNLASLAEEGRAGHRPQLSELTNRRRGRLRWFSHSTRSTHSTSSHASLPASDTGSITDTPGDEDEEEGTMASCTLCLNKIMKTKVCRHFRRANRGLRARCRRAVKSNACYWAVLLLVFLNTLTIASEHHGQPVWLTQTQEYANKVLLCLFTVEMLLKLYGLGPSVYVASFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCVYFIILFICGNYILLNVFLAIAVDNLASGDAGAAKDKGREKSSEGNPPQENKVLVPGGENEDTEGTKSEGAAPGMEEEEEEEEEEEEENGAGHVELLQEVVPKEKVVPIPEGSAFFCLSQTNPLRKACHTLIHHHVFTSLILVFIILSSVSLAAEDPIRAHSFRNHILGYFDYAFTSIFTVEILLKMTVFGAFLHQGSFCRSWFNLLDLLVVSVSLISFGIHSSAISVVKILRVLRVLRPLRAINRAKGLKHVVQCVFVAIRTIGNIMIVTTLLQFMFACIGVQLFKGKFYSCTDEAKHTLKECKGSFLIYPDGDVSRPLVRERLWVNSDFNFDNVLSAMMALFTVSTFEGWPALLYKAIDAHAEDEGPIYNYHVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTVEMVLKIIAFKPKHYFADAWNTFDALIVVGSVVDIAVTEVNNGGHLGESSEDSSRISITFFRLFRVMRLVKLLSKGEGIRTLLWTFIKSFQALPHVALLIAMIFFIYAVIGMQMFGKVALQDGTQINRNNNFQTFPQAVLLLFRCATGEAWQEIMLASLPGNRCDPESDFGPGEEFTCGSNFAIVYFISFFMLCAFLIINLFVAVIMDNFDYLTRDWSILGPHHLDEFKRIWSEYDPGAKGRIKHLDVVALLRRIQPPLGFGKLCPHRVACKRLVAMNVPLNSDGTVTFNATLFALVRTSLRIKTEGNLDQANQELRMVIKKIWKRIKQKLLDEVIPPPDEEEVTVGKFYATFLIQDYFRKFRRRKEKGLLGADAPTSTSSVLQAGLRSLQDLGPEIRQALTYALEEEEEEEEARQVKEAEEEEAETTPETYKDSIDSQPQAQWNSRISVSLPKLRETPDSLSTGPSDDDGVAPNSRQPSGLQAGSQPHRRGSGVFMFTIPEEGSTQLKGVQGQDNQNEEQEVPDWTPNLDEQAGMPSNPVLLPPHWSQQHVNGHHVPRRRLLPPTPAGRKPSFTIQCLQRQGSCEDLPIPGTYHRGRTSGPGRAQGSWAAPPQKGRLLYAPLLLVEESTVGEGYLGKLGGPLRTFTCLQVPGAPSDPSHRKRGSADSLVEAVLISEGLGLFAQDPRFVALAKQEIADACHLTLDEMDSAASDLLAQRTTSLYSDEESILSRFDEEDLGDEMACVHAL

SEQ ID NO: 123 - protein, 2512 aa, Homo sapiens
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 124 - protein, 2266 aa, Homo sapiens
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDGALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNPNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQ

SEQ ID NO: 125 - protein, 2368 aa, Mus musculus
MARFGDEMPGRYGAGGGGSGPAAGVVVGAAGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIVALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDVEQRHPFDGALRRATLKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPTKSVWEQRTSEMRKQNLLASREALYGDAAERWPTPYARPLRPDVKTHLDRPLVVDPQENRNNNTNKSRAPEALRPTARPRESARDPDARRAWPGSPERAPGREGPYGRESEPQQREHAPPREHAPWDADTERAKAGDAPRRHTHRPVAEGEPRRHRARRRPGDEPDDRPERRPRPRDATRPARAADGEGDDGERKRRHRHGPPAHDDRERRHRRRKENQGSGVPVSGPNLSTTRPIQQDLGRQDLPLAEDLDNMKNNKLATGEPASPHDSLGHSGLPPSPAKIGNSTNPGPALATNPQNAASRRTPNNPGNPSNPGPPKTPENSLIVTNPSSTQPNSAKTARKPEHMAVEIPPACPPLNHTVVQVNKNANPDPLPKKEEEKKEEEEADPGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFERDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDGEDEDSDEDEFQITEHNNFRTFFQALMLLFRSATGEAWHNIMLSCLSGKPCDKNSGILTADCGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQNRTPLMFQRMEPPSPTQEGGPSQNALPSTQLDPGGGLMAHEGGMKESPSWVTQRAQEMFQKTGTWSPERGPPIDMPNSQPNSQSVEMREMGTDGYSDSEHYLPMEGQTRAASMPRLPAENQRRRGRPRGNDLSTISDTSPMKRSASVLGPKARRLDDYSLERVPPEENQRYHQRRRDRGHRTSERSLGRYTDVDTGLGTDLSMTTQSGDLPSKDRDQDRGRPKDRKHRPHHHHHHHHHHPPAPDRDRYAQERPDTGRARAREQRWSRSPSEGREHTTHRQGSSSVSGSPAPSTSGTSTPRRGRRQLPQTPCTPRPLVSYSPAPRRPAARRMAGPAAPPGGSPRGCRRAPRWPAHAPEGPRPRGADYTEPDSPREPPGGAHDPAPRSPRTPRAAGCASPRHGRRLPNGYYAGHGAPRPRTARRGAHDAYSESEDDWC

SEQ ID NO: 126 - protein, 2368 aa, Rattus norvegicus
MARFGDEMPGRYGAGGGGSGPAAGVVVGAAGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIVALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDVEQRHPFDGALRRATLKKSKTDLLNPEEAEDQLADIASVGSPFARASIKSAKLENSTFFHKKERRMRFYIRRMVKTQAFYWTVLSLVALNTLWLAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDEIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYGDAAERWPTTYARPLRPDVKTHLDRPLVVDPQENRNNNTNKSRAPEALRQTARPRESARDPDARRAWPSSPERAPGREGPYGRESEPQQREHAPPREHVPWDADPERAKAGDAPRRHTHRPVAEGEPRRHRARRRPGDEPDDRPERRPRPRDATRPARAADGEGDDGERKRRHRHGPPAHDDRERRHRRRKESQGSGVPMSGPNLSTTRPIQQDLGRQDLPLAEDLDNMKNNKLATGEPASPHDSLGHSGLPPSPAKIGNSTNPGPALATNPQNAASRRTPNNPGNPSNPGPPKTPENSLIVTNPSSTQPNSAKTARKPEHMAVEIPPACPPLNHTVVQVNKNANPDPLPKKEEEKKEEEEADPGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFERDCRGKYLLYEKNEVKARDREWKKYDFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDGEDEDSDEDEFQITEHNNFRTFFQALMLLFRSATGEAWHNIMLSCLSGKPCDKNSGIQKPECGNEFAYFYFVSFIFLCSFLMLNLFVAVIMDNFEYLTRDSSILGPHHLDEYVRVWAEYDPAACGRIHYKDMYSLLRVISPPLGLGKKCPHRVACKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQNRTPLMFQRMEPPSPTQEGGPSQNALPSTQLDPGGGLMAQESSMKESPSWVTQRAQEMFQKTGTWSPERGPPIDMPNSQPNSQSVEMREMGTDGYSDSEHYLPMEGQTRAASMPRLPAENQRRRGRPRGNNLSTISDTSPMKRSASVLGPKARRLDDYSLERVPPEENQRYHQRRRDRGHRTSERSLGRYTDVDTGLGTDLSMTTQSGDLPSKDRDQDRGRPKDRKHRPHHHHHHHHHHPPAPDRERYAQERPDTGRARAREQRWSRSPSEGREHATHRQGSSSVSGSPAPSTSGTSTPRRGRRQLPQTPCTPRPLVSYSPAPRRPAARRMAGPPAPPGGSPRGCRRAPRWPAHAPEGPRPRGADYTEPDSPREPPGGAHEPAPRSPRTPRAAGCASPRHGRRLPNGYYAGHGAPRPRTARRGAHDAYSESEDDWC

SEQ ID NO: 127 - protein, 2339 aa, Homo sapiens [sequence omitted]

SEQ ID NO: 128 - protein, 2327 aa, Mus musculus
MVRFGDELGGRYGGTGGGERARGGGAGGAGGPGQGGLPPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDTEPVGDFPCGKDPPARQCDGDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDKNAEEKSPLDVLKRAATKKSRNDLIHAEEGEDRFVDLCAVGSPFARASLKSGKTESSSYFRRKEKMFRFFIRRMVKAQSFYWVVLCVVALNTLCVAMVHYNQPQRLTTALYFAEFVFLGLFLTEMSLKMYGLGPRSYFRSSFNCFDFGVIVGSIFEVVWAAIKPGTSFGISVLRALRLLRIFKVTKYWNSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRYASTRHVRPDMKTHMDRPLVVEPGRDGLRGPVGSKSKPEGTEATESADLPRRHHRHRDRDKTSATAPAGGEQDRTESTETGAREERARPRRSHSKETPGADTQVRCERSRRHHRRGSPEEATEREPRRHRAHRHAQDSSKEGTAPVLVPKGERRARHRGPRTGPREAENNEEPTRRHRARHKVPPTLQPPEREAAEKESNAVEGDKETRNHQPKEPHCDLEAIAVTGVGPLHMLPSTCLQKVDEQPEDADNQRNVTRMGSQPSDPSTTVHVPVTLTGPPGETPVVPSGNMNLEGQAEGKKEAEADDVLRRGPRPIVPYSSMFCLSPTNLLRRFCHYIVTMRYFEMVILVVIALSSIALAAEDPVRTDSFRNNALKYMDYIFTGVFTFEMVIKMIDLGLLLHPGAYFRDLWNILDFIVVSGALVAFAFSSFMGGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGFRMELSIFYVVYFVVFPFFFVNIFVALIIITFQEQGDKVMSECSLEKNERACIDFAISAKPLTRYMPQNKQSFQYKTWTFVVSPPFEYFIMAMIALNTVVLMMKFYDAPYEYELMLKCLNIVFTSMFSMECILKIIAFGVLNYFRDAWNVFDFVTVLGSITDILVTEIANNFINLSFLRLFRAARLIKLLRQGYTIRILLWTFVQSFKALPYVCLLIAMLFFIYAIIGMQVFGNIALDDDTSINRHNNFRTFLQALMLLFRSATGEAWHEIMLSCLGNRACDPHANASECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISSVWANLPQKTLDLLVPPHKPDEMTVGKVYAALMIFDFYKQNKTTRDQTHQAPGGLSQMGPVSLFHPLKATLEQTQPAVLRGARVFLRQKSATSLSNGGAIQTQESGIKESLSWGTQRTQDALYEARAPLERGHSAEIPVGQSGTLAVDVQMQNMTLRGPDGEPQPGLESQGRAASMPRLAAETQPAPNASPMKRSISTLAPRPHGTQLCSTVLDRPPPSQASHHHHHRCHRRRDKKQRSLEKGPSLSVDPEGAPSTAAGPGLPHGEGSTACRRDRKQERGRSQERRQPSSSSSEKQRFYSCDRFGSREPPQLMPSLSSHPTSPTAALEPAPHPQGSGSVNGSPLMSTSGASTPGRGGRRQLPQTPLTPRPSITYKTANSSPVHFAEGQSGLPAFSPGRLSRGLSEHNALLQKEPLSQPLAPGSRIGSDPYLGQRLDSEASAHTLPEDTLTFEEAVATNSGRSSRTSYVSSLTSQSHPLRRVPNGYHCTLGLSTGVRARHSYHHPDQDHWC

SEQ ID NO: 129 - protein, 2333 aa, Rattus norvegicus
MVRFGDELGGRYGGTGGGERARGGGAGGAGGPGQGGLPPGQRVLYKQSIAQRARTMALYNPIPVKQNCFTVNRSLFVFSEDNVVRKYAKRITEWPPFEYMILATIIANCIVLALEQHLPDGDKTPMSERLDDTEPYFIGIFCFEAGIKIIALGFVFHKGSYLRNGWNVMDFVVVLTGILATAGTDFDLRTLRAVRVLRPLKLVSGIPSLQVVLKSIMKAMVPLLQIGLLLFFAILMFAIIGLEFYMGKFHKACFPNSTDAEPVGDFPCGKEAPARLCDSDTECREYWPGPNFGITNFDNILFAILTVFQCITMEGWTDILYNTNDAAGNTWNWLYFIPLIIIGSFFMLNLVLGVLSGEFAKERERVENRRAFLKLRRQQQIERELNGYLEWIFKAEEVMLAEEDKNAEEKSPLDVLKRAATKKSRNDLIHAEEGEDRFVDLCAAGSPFARASLKSGKTESSSYFRRKEKMFRFLIRRMVKAQSFYWVVLCVVALNTLCVAMVHYNQPQRLTTALYFAEFVFLGLFLTEMSLKMYGLGPRSYFRSSFNCFDFGVIVGSIFEVVWAAIKPGTSFGISVLRALRLLRIFKVTKYWNSLRNLVVSLLNSMKSIISLLFLLFLFIVVFALLGMQLFGGQFNFQDETPTTNFDTFPAAILTVFQILTGEDWNAVMYHGIESQGGVSKGMFSSFYFIVLTLFGNYTLLNVFLAIAVDNLANAQELTKDEEEMEEAANQKLALQKAKEVAEVSPMSAANISIAARQQNSAKARSVWEQRASQLRLQNLRASCEALYSEMDPEERLRYASTRHVRPDMKTHMDRPLVVEPGRDGLRGPAGNKSKPEGTEATEGADPPRRHHRHRDRDKTSASTPAGGEQDRTDCPKAESTETGAREERARPRRSHSKEAPGADTQVRCERSRRHHRRGSPEEATEREPRRHRAHRHAQDSSKEGKEGTAPVLVPKGERRARHRGPRTGPRETENSEEPTRRHRAKHKVPPTLEPPEREVAEKESNVVEGDKETRNHQPKEPRCDLEAIAVTGVGSLHMLPSTCLQKVDEQPEDADNQRNVTRMGSQPSDPSTTVHVPVTLTGPPGEATVVPSANTDLEGQAEGKKEAEADDVLRRGPRPIVPYSSMFCLSPTNLLRRFCHYIVTMRYFEMVILVVIALSSIALAAEDPVRTDSFRNNALKYMDYIFTGVFTFEMVIKMIDLGLLLHPGAYFRDLWNILDFIVVSGALVAFAFSGSKGKDINTIKSLRVLRVLRPLKTIKRLPKLKAVFDCVVNSLKNVLNILIVYMLFMFIFAVIAVQLFKGKFFYCTDESKELERDCRGQYLDYEKEEVEAQPRQWKKYDFHYDNVLWALLTLFTVSTGEGWPMVLKHSVDATYEEQGPSPGFRMELSIFYVVYFVVFPFFFVNIFVALIIITFQEQGDKVMSECSLEKNERACIDFAISAKPLTRYMPQNKQSFQYKTWTFVVSPPFEYFIMAMIALNTVVLMMKFYDAPYEYELMLKCLNIVFTSMFSLECILKIIAFGVLNYFRDAWNVFDFVTVLGSITDILVTEIAETNNFINLSFLRLFRAARLIKLLRQGYTIRILLWTFVQSFKALPYVCLLIAMLFFIYAIIGMQVFGNIALDDGTSINRHNNFRTFLQALMLLFRSATGEAWHEIMLSCLGNRACDPHANASECGSDFAYFYFVSFIFLCSFLMLNLFVAVIMDNFEYLTRDSSILGPHHLDEFIRVWAEYDPAACGRISYNDMFEMLKHMSPPLGLGKKCPARVAYKRLVRMNMPISNEDMTVHFTSTLMALIRTALEIKLAPAGTKQHQCDAELRKEISSVWANLPQKTLDLLVPPHKPDEMTVGKVYAALMIFDFYKQNKTTRDQTHQAPGGLSQMGPVSLFHPLKATLEQTQPAVLRGARVFLRQKSATSLSNGGAIQTQESGIKESLSWGTQRTQDVLYEARAPLERGHSAEIPVGQPGALAVDVQMQNMTLRGPDGEPQPGLESQGRAASMPRLAAETQPAPNASPMKRSISTLAPRPHGTQLCNTVLDRPPPSQVSHHHHHRCHRRRDKKQRSLEKGPSLSVDTEGAPSTAAGSGLPHGEGSTGCRRERKQERGRSQERRQPSSSSSEKQRFYSCDRFGSREPPQPKPSLSSHPISPTAALEPGPHPQGSGSVNGSPLMSTSGASTPGRGGRRQLPQTPLTPRPSITYKTANSSPVHFAEGQSGLPAFSPGRLSRGLSEHNALLQKEPLSQPLASGSRIGSDPYLGQRLDSEASAHNLPEDTLTFEEAVATNSGRSSRTSYVSSLTSQSHPLRRVPNGYHCTLGLSTGVRARHSYHHPDQDHWC

SEQ ID NO: 130 - protein, 2270 aa, Homo sapiens
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 131 - protein, 2273 aa, Mus musculus
MARFGEAVVVGRPGSGDGDSDQSRNRQGTPVPASGPAAAYKQSKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNSGTSALEVLRRATIKRSRTEAMTRDSSDEHCVDISSVGTPLARASIKSTKVDGASYFRHKERLLRISIRHMVKSQVFYWIVLSVVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRRHMQMSSQEALNKEEAPPMNPLNPLNPLSPLNPLNAHPSLYRRPRPIEGLALGLGLEKCEEERISRGGSLKGDIGGLTSALDNQRSPLSLGKREPPWLPRSCHGNCDPIQQEAGGGETVVTFEDRARHRQSQRRSRHRRVRTEGKDSASASRSRSASQERSLDEGVSVEGEKEHEPHSSHRSKEPTIHEEERTQDLRRTNSLMVPRGSGLVGALDEAETPLVQPQPELEVGKDAALTEQEAEGSSEQALLGDVQLDVGRGISQSEPDLSCMTANMDKATTESTSVTVAIPDVDPLVDSTVVNISNKTDGEASPLKEAETKEEEEEVEKKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNESERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQEIFQLACMDPADDGQFQEQQSLVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSISDTSTPRRSRRQLPPVPPKPRPLLSYSSLMRHTGGISPPPDGSEGGSPLASQALESNSACLTESSNSLHPQQGQHPSPQHYISEPYLALHEDSHASDCGEEETLTFEAAVATSLGRSNTIGSAPPLRHSWQMPNGHYRRRRRGGPGPGMMCGAVSDLLSDTEEDDKC

SEQ ID NO: 132 - protein, 2295 aa, Rattus norvegicus
MARFGEAVVVGRPGSGDGDSDQSRNRQGTPVPASGPAAAYKQSKAQRATMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNSGTSALEVLRRATIKRSRTEAMTRDSSDEHCVDISSVGTPLARASIKSTKVDGASYFRHKERLLRISIRHMVKSQVFYWIVLSVVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVLYNGIRSQGGVSSGMWSAIYFIVLTLFGNYTLLNVFLAIAVDNLANAQELTKDEQEEEEAFNQKHALQKAKEVSPMSAPNMPSIERERRRRHHMSVWEQRTSQLRRHMQMSSQEALNKEEAPPMNPLNPLNPLSPLNPLNAHPSLYRRPRPIEGLPLGLGLEKCEEERISRGGSLKGDIGGLTSVLDNQRSPLSLGKREPPWLPRSCHGNCDPTQQETGGGETVVTFEDRARHRQSQRRSRHRRVRTEGKESASASRSRSASQERSLDEGVSIDGEKEHEPQSSHRSKEPTIHEEERTQDLRRTNSLMVPRGSGLVGALDEAETPLVQPQPELEVGKDAALTEQEAEGSSEQALLADVQLDVGRGISQSEPDLSCMTTNMDKATTESTSVTVAIPDVDPLVDSTVVNISNKTDGEASPLKEAETKEEEEEVEKKKQKKEKRETGKAMVPHSSMFIFSTTNPIRKACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPWTYELALKYLNIAFTMVFSLECVLKVIAFGFLNYFRDTWNIFDFITVIGSITEIILTDSKLVNTSGFNMSFLELFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNESERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIISNAKALPYLQQDPVSGLSGRSGYPSMSPLSPQEIFQLACMDPADDGQFQEQQSLEPEVSELKSVQSSNHGIYLPPDTQEHAGSGRASSMPRLTMDPQVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSISDTSTPRRSRRQLPPVPPKPRPLLSYSSLMRHTGGISPPPDGSEGGSPLASQALESNSACLTESSNSLHPQQGQHPSPQHYISEPYLALHEDSHASDCGEEETLTFEAAVATSLGRSNTIGSAPPLRHSWQMPNGHYRRRRLGGLGLAMMCGAVSDLLSDTEEDDKC

SEQ ID NO: 133 - protein, 2377 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 134 - protein, 2273 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 135 - protein, 2171 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 136 - protein, 2250 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 137 - protein, 2298 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 138 - protein, 2295 aa, Mus musculus
MDEEEDGAGAEESGQPRSFTQLNDLSGAGGRQGPGSTEKDPGSADSEAEGLPYPALAPVVFFYLSQDSRPRSWCLRTVCNPWFERVSMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLEPYYQTENEDESPFICSQPRENGMRSCRSVPTLRGEGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAVGVRAGLLSSPVARGGQEPQPSGSCSRSHRRLSVHHLVHHHHHHHHHYHLGNGTLRVPRASPEIQDRDANGSRWLMLPPPSTPTPSGGPPRGAESVHSFYHADCHLEPVRCQAPPPRSPSEASGRTVGSGKVYPTVHTSPPPEMLKDKALVEVAPSPGPPTLTSFNIPPGPFSSMHKLLETQSTGACHSSCKISSPCSKADSGACGPDSCPYCARTGAGEPESADHEMPDSDSEAVYEFTQDAQHSDLRDPHRRRRPSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEIGKREDTSGQLSCIQLPVNSQGGDATKSESEPDFFSPSVDGDGDRKKRLALVALGEHSELRKSLLPPLIIHTAATPMSLPKSSSTGVGEALGSGSRRTSSSGSAEPGTAHHEMKSPPSARSSPHSPWSAASSWTSRRSSRNSLGRAPSLKRRSPSGERRSLLSGEGQESQDEEESSEEDRASPAGSDHRHRGSLEREAKSSFDLPDTLQVPGLHRTASGRSSASEHQDCNGKSASGRLARTLRADDPPLDGDDGDDEGNLSKGERLRAWVRARLPACCRERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLKRLEKKRRSKEKQMADLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGVNSPDSPKPGAPHTTAHIGAASSGFSLEHPTMVPHTEEGPVPLGPDLLTVRKSGVSRTHSLPNDSYMCRNGSTAERSLGHRGWGLPKAQSGSILSVHSQPADTSCILQLPKDAHYLLQPHGAPTWGAIPKLPPPGRSPLAQRPLRRQAAIRTDSLDVQGLGSREDLLSEVSGPSCPLTRSSSFWGGSSIQVQQRSGSQSKVSKHIRLPAPCPGLEPSWAKDPQETRSSLELDTELSWISGDLLPSSQEEPLSPRDLKKCYSVEAQSCRRRPGSWLDEQRRHSIAVSCLDSGSQPRLCPSPSSLGGQPLGGPGSRPKKKLSPPSISIDPPESQGPRPPCSPGVCLRRRAPASDSKDPSASSPLDSTAASPSPKKDALSLSGLSSDPTDLDP

SEQ ID NO: 139 - protein, 2254 aa, Rattus norvegicus
MDEEEDGAGAEESGQPRSFTQLNDLSGAGGRQGPGSTEKDPGSADSEAEGLPYPALAPVVFFYLSQDSRPRSWCLRTVCNPWFERVSMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLEPYYQTENEDESPFICSQPRENGMRSCRSVPTLRGEGGGGPPCSLDYETYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAIGVRAGLLSSPVARSGQEPQPSGSCTRSHRRLSVHHLVHHHHHHHHHYHLGNGTLRVPRASPEIQDRDANGSRRLMLPPPSTPTPSGGPPRGAESVHSFYHADCHLEPVRCQAPPPRCPSEASGRTVGSGKVYPTVHTSPPPEILKDKALVEVAPSPGPPTLTSFNIPPGPFSSMHKLLETQSTGACHSSCKISSPCSKADSGACGPDSCPYCARTGAGEPESADHVMPDSDSEAVYEFTQDAQHSDLRDPHSRRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDATKSESEPDFFSPSVDGDGDRKKRLALVALGEHAELRKSLLPPLIIHTAATPMSHPKSSSTGVGEALGSGSRRTSSSGSAEPGAAHHEMKCPPSARSSPHSPWSAASSWTSRRSSRNSLGRAPSLKRRSPSGERRSLLSGEGQESQDEEESSEEDRASPAGSDHRHRGSLEREAKSSFDLPDTLQVPGLHRTASGRSSASEHQDCNGKSASGRLARTLRTDDPQLDGDDDNDEGNLSKGERIQAWVRSRLPACCRERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVFESVFKLVAFGFRRFFQDRWNQLDLAIVLLSIMGITLEEIEVNLSLPINPTIIRIMRVLRIARVLKLLKMAVGMRALLHTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGVNSTDSPKPGAPHTTAHIGAASGFSLEHPTMVPHPEEVPVPLGPDLLTVRKSGVSRTHSLPNDSYMCRNGSTAERSLGHRGWGLPKAQSGSILSVHSQPADTSCILQLPKDVHYLLQPHGAPTWGAIPKLPPPGRSPLAQRPLRRQAAIRTDSLDVQGLGSREDLLSEVSGPSCPLTRSSSFWGGSSIQVQQRSGIQSKVSKHIRLPAPCPGLEPSWAKDPPETRSSLELDTELSWISGDLLPSSQEEPLFPRDLKKCYSVETQSCRRRPGFWLDEQRRHSIAVSCLDSGSQPRLCPSPSSLGGQPLGGPGSRPKKKLSPPSISIDPPESQGSRPPCSPGVCLRRRAPASDSKDPSVSSPLDSTAASPSPKKDTLSLSGLSSDPTDMDP

SEQ ID NO: 140 - protein, 2353 aa, Homo sapiens
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRSTFPSPEAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 141 - protein, 2359 aa, Mus musculus
MTEGTLAADEVRVPLGASPSAPAAPVRASPASPGVPGREEQRGSGSSVLAPESPGTECGADLGADEEQPVPYPALAATVFFCLGQTTRPRSWCLRLVCNPWFEHISMLVIMLNCVTLGMFRPCEDVECRSERCSILEAFDDFIFAFFAVEMVIKMVALGLFGQKCYLGDTWNRLDFFIVMAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPSRRELRVQCTLGWEAYGQPQAEDGGAGRNACINWNQYYNVCRSGEFNPHNGAINFDNIGYAWIAIFQVITLEGWVDIMYYVMDAHSFYNFIYFILLIIVGSFFMINLCLVVIATQFSETKQRENQLMREQRARYLSNDSTLASFSEPGSCYEELLKYVGHIFRKVKRRSLRLYARWQSRWRKKVDPSSTLHGQGPRRRPRRAGRRTASVHHLVYHHHHHHHHHYHFSHGGPRRPSPEPGAGDTRLVRACVPPSPPSPGHGPPDSESVHSIYHADCHVEGPQERARVAHTIATAASLKLASGLGTMNYPTILPSGAVNSKGSTSSRPKGLRSAGTPGATAHSPLSLGSPSPYEKIQHVVGEQGLGRASSHLSGLSVPCPLPSPQAGTLTCELKSCPYCASALEDPEFEFSGSESGDSDAHGVYEFTQDVRHGDCRDPVQQPHEGGTPGHGNERWRPPLRTASQPGGLGRLWASFSSKLRRIVDSKYFNRGIMAAILVNTLSMGVEYHEQPDELTNALEISNIVFTSMFALEMLLKLLACGPLGYIRNPYNIFDGIVVIISVWEIVGQADGGLSVLRTFRLLRVLKLVRFLPALRRQLVVLMRTMDNVATFCMLLMLFIFIFSILGMHLFGCKFSLKTDSGDTVPDRKNFDSLLWAIVTVFQILTQEDWNVVLYNGMASTSSWAALYFVALMTFGNYVLFNLLVAILVEGFQAEGDATRSDTDEDKTSTHLEEDFDKLRDVQATEMKMYSLAVTPNGHLEGRGSLPPPLITHTAATPMPTPKSSPHLDMAHTLLDSRRSSSGSVDPQLGDQKSLASLRSSPCAPWGPNSAGSSRRSSWNSLGRAPSLKRRSQCGERESLLSGEGKGSTDDEAEDSRPNSGTHPGASPGPRATPLRRAESLGHRSTMDLCPPRPATLLPTKFRDCNGQMVALPSEFFLRIDSHKEDAAEFDDDIEDSCCFRLHKVLEPYAPQWCSSRESWALYLFPPQNRLRVSCQKVIAHKMFDHVVLVFIFLNCITIALERPDIDPGSTERAFLSVSNYIFTAIFVVEMMVKVVALGLLWGEHAYLQSSWNVLDGLLVLVSLVDIIVAVASAGGAKILGVLRVLRLLRTLRPLRVISRAPGLKLVVETLISSLRPIGNIVLICCAFFIIFGILGVQLFKGKFYYCEGTDTRNITTKAECHAAHYRWVRRKYNFDNLGQALMSLFVLSSKDGWVNIMYDGLDAVGIDQQPVQNHNPWMLLYFISFLLIVSFFVLNMFVGVVVENFHKCRQHQEAEEARRREEKRLRRLERRRRKAQRRPYYADYSHTRRSIHSLCTSHYLDLFITFIICLNVITMSMEHYNQPKSLDEALKYCNYVFTIVFVFEAALKLVAFGFRRFFKDRWNQLDLAIVLLSIMGIALEEIEMNAALPINPTIIRIMRVLRIARVLKLLKMATGMRALLDTVVQALPQVGNLGLLFMLLFFIYAALGVELFGRLECSEDNPCEGLSRHATFTNFGMAFLTLFRVSTGDNWNGIMKDTLRECTREDKHCLSYLPALSPVYFVTFVLVAQFVLVNVVVAVLMKHLEESNKEAREDAEMDAEIELEIAQGSTAQPPSTAQESQGTEPDTPNLLVVRKVSVSRMLSLPNDSYMFRPVAPAAAPHSHPLQEVEMETYTGPVTSAHSPSLEPRTSFQVPSAASSPARVSDPLCALSPRDTPRSLSLSRILCRQEAMHAESLEGQIDDAGEDSIPDYTEPAENISMSQAPLGTLRSPPCSPRPASVRTRKHTFGQHCISSRPPTLGGDDAEAADPADEEVSHITSSAHPWPATEPHSPEASPTASPAKGTVGSGRDPHRFCSVDAQSFLDKPGRPDAQRWSSVELDNGDGHLESGEVRARASELEPALGARRKKKMSPPCISIDPPTEDEGSSRPPAAEGGNTTLRRRTPSCEAALHRDCPESTEGPGTGGDPVAKGERWGQASCRAEHLTVPNFAFEPLDMGGPGGDCFLDSDQSVTPEPRVSSLGAIVPLILETELSMPSGDPPEKEQGLYLTVPQTPLKKPGSPPATPAPDDSGDEPV

SEQ ID NO: 142 - protein, 2359 aa, Rattus norvegicus
MTEGTLAADEVRVPLGASPPAPAAPVRASPASPGAPGREEQGGSGSGVLAPESPGTECGADLGADEEQPVPYPALAATVFFCLGQTTRPRSWCLRLVCNPWFEHISMLVIMLNCVTLGMFRPCEDVECRSERCSILEAFDDFIFAFFAVEMVIKMVALGLFGQKCYLGDTWNRLDFFIVMAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPSRRELRVQCTLGWEAYGQPQAEDGGAGRNACINWNQYYNVCRSGEFNPHNGAINFDNIGYAWIAIFQVITLEGWVDIMYYVMDAHSFYNFIYFILLIIMGSFFMINLCLVVIATQFSETKQRENQLMREQRARYLSNDSTLASFSEPGSCYEELLKYVGHIFRKVKRRSLRLYARWQSRWRKKVDPSSTVHGQGPGRRPRRAGRRTASVHHLVYHHHHHHHHHYHFSHGGPRRPSPEPGAGDNRLVRACAPPSPPSPGHGPPDSESVHSIYHADCHVEGPQERARVAHSIATAASLKLASGLGTMNYPTILPSGTVNSKGGTSSRPKGLRGAGAPGAAVHSPLSLGSPRPYEKIQDVVGEQGLGRASSHLSGLSVPCPLPSPQAGTLTCELKSCPYCASALEDPEFEFSGSESGDSDAHGVYEFTQDVRHGDCRDPVQQPHEVGTPGHSNERRRTPLRKASQPGGIGHLWASFSGKLRRIVDSKYFNRGIMAAILVNTLSMGVEYHEQPEELTNALEISNIVFTSMFALEMLLKLLACGPLGYIRNPYNIFDGIVVVISVWEIVGQANGGLSVLRTFRLLRVLKLVRFLPALRRQLVVLMRTMDNVATFCMLLMLFIFIFSILGMHLFGCKFSLKTDSGDTVPDRKNFDSLLWAIVTVFQILTQEDWNVVLYNGMASTSSWAALYFVALMTFGNYVLFNLLVAILVEGFQAEGDATRSDTDEDKTSTQLEGDFDKLRDLRATEMKMYSLAVTPNGHLEGRGSLPPPLITHTAATPMPTPKSSPNLDVAHALLDSRRSSSGSVDPQLGDQKSLASLRSSPCTPWGPNSAGSSRRSSWNSLGRAPSLKRRNQCGERESLLSGEGKGSTDDEAEDSRPSTGTHPGASPGPRATPLRRAESLDHRSTLDLCPPRPAALLPTKFHDCNGQMVALPSEFFLRIDSHKEDAAEFDDDIEDSCCFRLHKVLEPYAPQWCRSRESWALYLFPPQNRLRVSCQKVIAHKMFDHVVLVFIFLNCITIALERPDIDPGSTERAFLSVSNYIFTAIFVVEMMVKVVALGLLWGEHAYLQSSWNVLDGLLVLVSLVDIIVAMASAGGAKILGVLRVLRLLRTLRPLRVISRAPGLKLVVETLISSLRPIGNIVLICCAFFIIFGILGVQLFKGKFYYCEGTDTRNITTKAECHAAHYRWVRRKYNFDNLGQALMSLFVLSSKDGWVNIMYDGLDAVGIDQQPVQNHNPWMLLYFISFLLIVSFFVLNMFVGVVVENFHKCRQHQEAEEARRREEKRLRRLERRRRKAQRRPYYADYSHTRRSIHSLCTSHYLDLFITFIICLNVITMSMEHYNQPKSLDEALKYCNYVFTIVFVFEAALKLVAFGFRRFFKDRWNQLDLAIVLLSIMGIALEEIEMNAALPINPTIIRIMRVLRIARVLKLLKMATGMRALLDTVVQALPQVGNLGLLFMLLFFIYAALGVELFGRLECSEDNPCEGLSRHATFTNFGMAFLTLFRVSTGDNWNGIMKDTLRECTREDKHCLSYLPALSPVYFVTFMLVAQFVLVNVVVAVLMKHLEESNKEAREDAEMDAEIELEMAQGSTAQPPPTAQESQGTQPDTPNLLVVRKVSVSRMLSLPNDSYMFRPVAPAAAPHSHPLQEVEMETYTGPVTSAHSPPLEPRASFQVPSAASSPARVSDPLCALSPRGTPRSLSLSRILCRQEAMHSESLEGKVDDVGGDSIPDYTEPAENMSTSQASTGAPRSPPCSPRPASVRTRKHTFGQRCISSRPPTLGGDEAEAADPADEEVSHITSSAHPWPATEPHSPEASPTASPVKGTMGSGRDPRRFCSVDAQSFLDKPGRPDAQRWSSVELDNGESHLESGEVRGRASELEPALGSRRKKKMSPPCISIEPPTKDEGSSRPPAAEGGNTTLRRRTPSCEAALHRDCPEPTEGPGTGGDPVAKGERWGQASCRAEHLTVPNFAFEPLDMGGPGGDCFLDSDQSVTPEPRVSSLGAIVPLILETELSMPSGDCPEKEQGLYLTVPQTPLKKPGSTPATPAPDDSGDEPV

SEQ ID NO: 143 - protein, 2223 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYHGKTKGQGDEGRHLGSRHCQTLHGPASPGNDHSGRELCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 144 - protein, 2188 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYQLCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 145 - protein, 2199 aa, Mus musculus
MADSNLPPSSSAAPDPEPGITEQPGPRSPPPSPPGLEEPLDGTNPDVPHPDLAPVAFFCLRQTTSPRNWCIKMVCNPWFECVSMLVILLNCVTLGMYQPCDDMECLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDMYDFGAGRQDLNASGLCVNWNRYYNVCRTGNANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQNRRQATGPGTPAPAKPGPHAKEPSHCKLCPRHSPLDTTPHTLVQPISAILASDPSSCPRCQHEAGRRPSGLGSTDSGQEGSGSGGSAEAEANGDGPQSSEDGVSSGLGKEEEQEDGAARLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTTPWASLYFVALMTFGNYVLFNLLVAILVEGFQAEGDANRSYSDEDQSSSNLEELDKLPEGLDSSRDLKLCPIPMTPNGHLDPSLPLGGHLGPAGAMGAAPRLSLQPDPVLVALESRKSSVMSLGRMSYDQRSLSSSRSSYYGPWGRSGTWASRRSSWNSLKHKPPSAEHESLLSGERGGSCVRACEGAREDAPPRAAPLHAPHTHHAHHGPHLAHRHRHHRRTLSLDTRDSVDLAELVPVVGAHSRAAWRAAGQAPGHEDCNGRMPNIAKDVFTKMDDRRDRGEDEEEIDYTLCFRVRKMIDVYKPDWCEVREDWSVYLFSPENKFRILCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSVASAGGAKILGVLRVLRLLRTLRPLRVISRAPGLKLVVETLISSLKPIGNIVLICCAFFIIFGILGVQLFKGKFYHCLGVDTRNITNRSDCVAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCPTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAEIELEMAHGLGPGPGPCPCPCPCPCPCPCPGPRMPTSSPGAPGRGSGGAGVGGDTESHLCRHCYSPAQETLWLDSVSLIIKDSLEGELTIIDNLSGSIFHHYSSPAGCDKCHHDKQEVQLAETEAFSLNSDRSSSVLLGDDLSLEDPTACPQGPKESKGELEPPEPMQAGDLDECFFPFAGEPVSAGPESLLCEMGAIPFNPVQSWLKHESNQAPPSPFSPDGSSPLLQMPAEFFHPAVSASQKGQEPGMSSGTLPKIALQGSWASLRSPSVNCTLLRQATVSDTSLDASPSSSAGSLQTTLEDSLTLSDSPRRALGPPVQVPGPRASLSPATRRRLSLRGRGLFSLRGLRAHQRSHSSGGSTSPGCTYHDSMDPSDEEGRGGAGGGGAGSEHSETLSSLSLTSLFCLPPTLPPPGLTPARKFSSTSSLAAGPGRPGATVSVRGLARSPSWAADRSKDPPGQAQLASGFGSSAPEPQPPPGESTDAASKRKR

SEQ ID NO: 146 - protein, 2201 aa, Rattus norvegicus
MADSNLPPSSAAAPAPEPGITEQPGPRSPPPSPPGLEEPLEGTNPDVPHPDLAPVAFFCLRQTTSPRNWCIKMVCNPWFECVSMLVILLNCVTLGMYQPCDDMECLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLTGDNGIMGCHEIPPLKEQGRECCLSKDDVYDFGAGRQDLNASGLCVNWNRYYNVCRTGNANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQNRRQAMGPGTPAPAKPGPHAKEPSHCKLCPRHSPLDPTPHTLVQPISAILASDPSSCPHCQHEAGRRPSGLGSTDSGQEGSGSGGSAEAEANGDGPQSSEDGVSSDLGKEEEQEDGAARLCGDVWRETREKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTTPWASLYFVALMTFGNYVLFNLLVAILVEGFQAEGDANRSYSDEDQSSSNLEEFDKLPEGLDNSRDLKLCPIPMTPNGHLDPSLPLGAHLGPAGTMGTAPRLSLQPDPVLVALDSRKSSVMSLGRMSYDQRSLSSSRSSYYGPWGRSGTWASRRSSWNSLKHKPPSAEHESLLSGEGGGSCVRACEGAREEAPTRTAPLHAPHAHHAHHGPHLAHRHRHHRRTLSLDTRDSVDLGELVPVVGAHSRAAWRGAGQAPGHEDCNGRMPNIAKDVFTKMDDCRDRGEDEEEIDYTLCFRVRKMIDVYKPDWCEVREDWSVYLFSPENKFRILCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSVASAGGAKILGVLRVLRLLRTLRPLRVISRAPGLKLVVETLISSLKPIGNIVLICCAFFIIFGILGVQLFKGKFYHCLGVDTRNITNRSDCVAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCPTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAEIELEMAHGLGPCPGPCPGPCPCPWPLAPVLARGCPLVLLGATGARIGRGRCWRRHRESPVPSTRYSPAQETLWLDSVSLIIKDSLEGELTIIDNLSGSVFHHYASPDGCGKCHHDKQEVQLAETEAFSLNSDRSSSILLGDDLSLEDPTACPPGRKDSKGELDPPEPMRVGDLGECFFPLSSTAVSPDPENFLCEMEEIPFNPVQSWLKHDSSQAPPSPFSPDGSSPLLQMPAEFFHPAVSASQKGPEKGTGTGTLPKIALQGSWASLRSPSVNCTLLRQATGSDTSLDASPSSSAGSLQTTLEDSLTLSDSPRRALGPPVQVPGPRASLSPATRRRLSLRGRGLFSLRGLRAHQRSHSSGGSTSPGCTHHDSMDPSDEEGRGGAGGGGAGSEHSETLSSLSLTSLFCLPPTLPPPGLTPARKFNSTSSLAAGPGRPGSTVSARGLVRSPSWAADRSKDPPGQAQLVSGLGSSAPGPQPPPGESTDAASKRKR

SEQ ID NO: 147 - protein, 495 aa, Homo sapiens
MTVMSGENVDEASAAPGHPQDGSYPRQADHDDHECCERVVINISGLRFETQLKTLAQFPNTLLGNPKKRMRYFDPLRNEYFFDRNRPSFDAILYYYQSGGRLRRPVNVPLDMFSEEIKFYELGEEAMEKFREDEGFIKEEERPLPEKEYQRQVWLLFEYPESSGPARVIAIVSVMVILISIVIFCLETLPELKDDKDFTGTVHRIDNTTVIYNSNIFTDPFFIVETLCIIWFSFELVVRFFACPSKTDFFKNIMNFIDIVAIIPYFITLGTEIAEQEGNQKGEQATSLAILRVIRLVRVFRIFKLSRHSKGLQILGQTLKASMRELGLLIFFLFIGVILFSSAVYFAEAEEAESHFSSIPDAFWWAVVSMTTVGYGDMYPVTIGGKIVGSLCAIAGVLTIALPVPVIVSNFNYFYHRETEGEEQAQLLHVSSPNLASDSDLSRRSSSTMSKSEYMEIEEDMNNSIAHYRQVNIRTANCTTANQNCVNKSKLLTDV

SEQ ID NO: 148 - protein, 499 aa, Homo sapiens
MTVATGDPADEAAALPGHPQDTYDPEADHECCERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRELGLLIFFLFIGVILFSSAVYFAEADERESQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 149 - protein, 575 aa, Homo sapiens
MDERLSLLRSPPPPSARHRAHPPQRPASSGGAHTLVNHGYAEPAAGRELPPDMTVVPGDHLLEPEVADGGGAPPQGGCGGGGCDRYEPLPPSLPAAGEQDCCGERVVINISGLRFETQLKTLCQFPETLLGDPKRRMRYFDPLRNEYFFDRNRPSFDAILYYYQSGGRIRRPVNVPIDIFSEEIRFYQLGEEAMEKFREDEGFLREEERPLPRRDFQRQVWLLFEYPESSGPARGIAIVSVLVILISIVIFCLETLPEFRDEKDYPASTSQDSFEAAGNSTSGSRAGASSFSDPFFVVETLCIIWFSFELLVRFFACPSKATFSRNIMNLIDIVAIIPYFITLGTELAERQGNGQQAMSLAILRVIRLVRVFRIFKLSRHSKGLQILGQTLKASMRELGLLIFFLFIGVILFSSAVYFAEADDPTSGFSSIPDAFWWAVVTMTTVGYGDMHPVTIGGKIVGSLCAIAGVLTIALPVPVIVSNFNYFYHRETEGEEQSQYMHVGSCQHLSSSAEELRKARSNSTLSKSEYMVIEEGGMNHSAFPQTPFKTGNSTATCTTNNNPNSCVNIKKIFTDV

SEQ ID NO: 150 - protein, 653 aa, Homo sapiens
MEVAMVSAESSGCNSHMPYGYAAQARARERERLAHSRAAAAAAVAAATAAVEGSGGSGGGSHHHHQSRGACTSHDPQSSRGSRRRRRQRSEKKKAHYRQSSFPHCSDLMPSGSEEKILRELSEEEEDEEEEEEEEEEGRFYYSEDDHGDECSYTDLLPQDEGGGGYSSVRYSDCCERVVINVSGLRFETQMKTLAQFPETLLGDPEKRTQYFDPLRNEYFFDRNRPSFDAILYYYQSGGRLKRPVNVPFDIFTEEVKFYQLGEEALLKFREDEGFVREEEDRALPENEFKKQIWLLFEYPESSSPARGIAIVSVLVILISIVIFCLETLPEFRDDRDLVMALSAGGHGGLLNDTSAPHLENSGHTIFNDPFFIVETVCIVWFSFEFVVRCFACPSQALFFKNIMNIIDIVSILPYFITLGTDLAQQQGGGNGQQQQAMSFAILRIIRLVRVFRIFKLSRHSKGLQILGHTLRASMRELGLLIFFLFIGVILFSSAVYFAEADEPTTHFQSIPDAFWWAVVTMTTVGYGDMKPITVGGKIVGSLCAIAGVLTIALPVPVIVSNFNYFYHRETENEEQTQLTQNAVSCPYLPSNLLKKFRSSTSSSLGDKSEYLEMEEGVKESLCAKEEKCQGKGDDSETDKNNCSNAKAVETDV

SEQ ID NO: 151 - protein, 613 aa, Homo sapiens
MEIALVPLENGGAMTVRGGDEARAGCGQATGGELQCPPTAGLSDGPKEPAPKGRGAQRDADSGVRPLPPLPDPGVRPLPPLPEELPRPRRPPPEDEEEEGDPGLGTVEDQALGTASLHHQRVHINISGLRFETQLGTLAQFPNTLLGDPAKRLRYFDPLRNEYFFDRNRPSFDGILYYYQSGGRLRRPVNVSLDVFADEIRFYQLGDEAMERFREDEGFIKEEEKPLPRNEFQRQVWLIFEYPESSGSARAIAIVSVLVILISIITFCLETLPEFRDERELLRHPPAPHQPPAPAPGANGSGVMAPPSGPTVAPLLPRTLADPFFIVETTCVIWFTFELLVRFFACPSKAGFSRNIMNIIDVVAIFPYFITLGTELAEQQPGGGGGGQNGQQAMSLAILRVIRLVRVFRIFKLSRHSKGLQILGKTLQASMRELGLLIFFLFIGVILFSSAVYFAEADNQGTHFSSIPDAFWWAVVTMTTVGYGDMRPITVGGKIVGSLCAIAGVLTIALPVPVIVSNFNYFYHRETDHEEPAVLKEEQGTQSQGPGLDRGVQRKVSGSRGSFCKAGGTLENADSARRGSCPLEKCNVKAKSNVDLRRSLYALCLDTSRETDL

SEQ ID NO: 152 - protein, 529 aa, Homo sapiens
MRSEKSLTLAAPGEVRGPEGEQQDAGDFPEAGGGGGCCSSERLVINISGLRFETQLRTLSLFPDTLLGDPGRRVRFFDPLRNEYFFDRNRPSFDAILYYYQSGGRLRRPVNVPLDIFLEEIRFYQLGDEALAAFREDEGCLPEGGEDEKPLPSQPFQRQVWLLFEYPESSGPARGIAIVSVLVILISIVIFCLETLPQFRVDGRGGNNGGVSRVSPVSRGSQEEEEDEDDSYTFHHGITPGEMGTGGSSSLSTLGGSFFTDPFFLVETLCIVWFTFELLVRFSACPSKPAFFRNIMNIIDLVAIFPYFITLGTELVQQQEQQPASGGGGQNGQQAMSLAILRVIRLVRVFRIFKLSRHSKGLQILGKTLQASMRELGLLIFFLFIGVILFSSAVYFAEADDDDSLFPSIPDAFWWAVVTMTTVGYGDMYPMTVGGKIVGSLCAIAGVLTIALPVPVIVSNFNYFYHRETEQEEQGQYTHVTCGQPAPDLRATDNGLGKPDFPEANRERRPSYLPTPHRAYAEKRMLTEV

SEQ ID NO: 153 - protein, 456 aa, Homo sapiens
MEPRCPPPCGCCERLVLNVAGLRFETRARTLGRFPDTLLGDPARRGRFYDDARREYFFDRHRPSFDAVLYYYQSGGRLRRPAHVPLDVFLEEVAFYGLGAAALARLREDEGCPVPPERPLPRRAFARQLWLLFEFPESSQAARVLAVVSVLVILVSIVVFCLETLPDFRDDRDGTGLAAAAAAGPFPAPLNGSSQMPGNPPRLPFNDPFFVVETLCICWFSFELLVRLLVCPSKAIFFKNVMNLIDFVAILPYFVALGTELARQRGVGQQAMSLAILRVIRLVRVFRIFKLSRHSKGLQILGQTLRASMRELGLLIFFLFIGVVLFSSAVYFAEVDRVDSHFTSIPESFWWAVVTMTTVGYGDMAPVTVGGKIVGSLCAIAGVLTISLPVPVIVSNFSYFYHRETEGEEAGMFSHVDMQPCGPLEGKANGGLVDGEVPELPPPLWAPPGKHLVTEV

SEQ ID NO: 154 - protein, 511 aa, Homo sapiens
MDVCGWKEMEVALVNFDNSDEIQEEPGYATDFDSTSPKGRPGGSSFSNGKILISESTNHETAFSKLPGDYADPPGPEPVVLNEGNQRVIINIAGLRFETQLRTLSQFPETLLGDREKRMQFFDSMRNEYFFDRNRPSFDGILYYYQSGGKIRRPANVPIDIFADEISFYELGSEAMDQFREDEGFIKDPETLLPTNDIHRQFWLLFEYPESSSAARAVAVVSVLVVVISITIFCLETLPEFREDRELKVVRDPNLNMSKTVLSQTMFTDPFFMVESTCIVWFTFELVLRFVVCPSKTDFFRNIMNIIDIISIIPYFATLITELVQETEPSAQQNMSLAILRIIRLVRVFRIFKLSRHSKGLQILGQTLKASMRELGLLIFFLFIGVILFSSAVYFAEVDEPESHFSSIPDGFWWAVVTMTTVGYGDMCPTTPGGKIVGTLCAIAGVLTIALPVPVIVSNFNYFYHRETENEEKQNIPGEIERILNSVGSRMGSTDSLNKTNGGCSTEKSRK

SEQ ID NO: 155 - protein, 858 aa, Homo sapiens [sequence omitted]

SEQ ID NO: 156 - protein, 911 aa, Homo sapiens
MAEKAPPGLNRKTSRSTLSLPPEPVDIIRSKTCSRRVKINVGGLNHEVLWRTLDRLPRTRLGKLRDCNTHESLLEVCDDYNLNENEYFFDRHPGAFTSILNFYRTGKLHMMEEMCALSFGQELDYWGIDEIYLESCCQARYHQKKEQMNEELRREAETMREREGEEFDNTCCPDKRKKLWDLLEKPNSSVAAKILAIVSILFIVLSTIALSLNTLPELQETDEFGQLNDNRQLAHVEAVCIAWFTMEYLLRFLSSPNKWKFFKGPLNVIDLLAILPYYVTIFLTESNKSVLQFQNVRRVVQIFRIMRILRILKLARHSTGLQSLGFTLRRSYNELGLLILFLAMGIMIFSSLVFFAEKDEDATKFTSIPASFWWATITMTTVGYGDIYPKTLLGKIVGGLCCIAGVLVIALPIPIIVNNFSEFYKEQKRQEKAIKRREALERAKRNGSIVSMNLKDAFARSMELIDVAVEKAGESANTKDSADDNHLSPSRWKWARKALSETSSNKSFENKYQEVSQKDSHEQLNNTSSSSPQHLSAQKLEMLYNEITKTQPHSHPNPDCQEKPERPSAYEEEIEMEEVVCPQEQLAVAQTEVIVDMKSTSSIDSFTSCATDFTETERSPLPPPSASHLQMKFPTDLPGTEEHQRARGPPFLTLSREKGPAARDGTLEYAPVDITVNLDASGSQCGLHSPLQSDNATDSPKSSLKGSNPLKSRSLKVNFKENRGSAPQTPPSTARPLPVTTADFSLTTPQHISTILLEETPSQGDRPLLGTEVSAPCQGPSKGLSPRFPKQKLFPFSSRERRSFTEIDTGDDEDFLELPGAREEKQVDSSPNCFADKPSDGRDPLREEGSVGSSSPQDTGHNCRQDIYHAVSEVKKDSSQEGCKMENHLFAPEIHSNPGDTGYCPTRETSM

SEQ ID NO: 157 - protein, 511 aa, Homo sapiens
MGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVIFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRAGRKPLRGMSI

SEQ ID NO: 158 - protein, 638 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKGYEKSRSLNNIAGLAGNALRLSPVTSPYNSPCPLRRSRSPIPSIL

SEQ ID NO: 159 - protein, 558 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSDNCKEVVITGYTQAEARSLT

SEQ ID NO: 160 - protein, 613 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKDNCKEVVITGYTQAEARSLT

SEQ ID NO: 161 - protein, 757 aa, Homo sapiens
MLSSVCVSSFRGRQGASKQQPAPPPQPPESPPPPPLPPQQQQPAQPGPAASPAGPPAPRGPGDRRAEPCPGLPAAAMGRHGGGGGDSGKIVINVGGVRHETYRSTLRTLPGTRLAGLTEPEAAARFDYDPGADEFFFDRHPGVFAYVLNYYRTGKLHCPADVCGPLFEEELGFWGIDETDVEACCWMTYRQHRDAEEALDSFEAPDPAGAANAANAAGAHDGGLDDEAGAGGGGLDGAGGELKRLCFQDAGGGAGGPPGGAGGAGGTWWRRWQPRVWALFEDPYSSRAARYVAFASLFFILISITTFCLETHEGFIHISNKTVTQASPIPGAPPENITNVEVETEPFLTYVEGVCVVWFTFEFLMRITFCPDKVEFLKSSLNIIDCVAILPFYLEVGLSGLSSKAAKDVLGFLRVVRFVRILRIFKLTRHFVGLRVLGHTLRASTNEFLLLIIFLALGVLIFATMIYYAERIGADPDDILGSNHTYFKNIPIGFWWAVVTMTTLGYGDMYPKTWSGMLVGALCALAGVLTIAMPVPVIVNNFGMYYSLAMAKQKLPKKKNKHIPRPPQPGSPNYCKPDPPPPPPPHPHHGSGGISPPPPITPPSMGVTVAGAYPAGPHTHPGLLRGGAGGLGIMGLPPLPAPGEPCPLAQEEVIEINRADPRPNGDPAAAALAHEDCPAIDQPAMSPEDKSPITPGSRGRYSRDRACFLLTDYAPSPDGSIRKATGAPPLPPQDWRKPGPPSFLPDLNANAAAWISP

SEQ ID NO: 162 - protein, 635 aa, Homo sapiens
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAACFLLSTGDYACADGSVRKGTFVLRDLPLQHSPEAACPPTAGTLFLPH

SEQ ID NO: 163 - protein, 647 aa, Homo sapiens
MAAGLATWLPFARAAAVGWLPLAQQPLPPAPGVKASRGDEVLVVNVSGRRFETWKNTLDRYPDTLLGSSEKEFFYDADSGEYFFDRDPDMFRHVLNFYRTGRLHCPRQECIQAFDEELAFYGLVPELVGDCCLEEYRDRKKENAERLAEDEEAEQAGDGPALPAGSSLRQRLWRAFENPHTSTAALVFYYVTGFFIAVSVIANVVETIPCRGSARRSSREQPCGERFPQAFFCMDTACVLIFTGEYLLRLFAAPSRCRFLRSVMSLIDVVAILPYYIGLLVPKNDDVSGAFVTLRVFRVFRIFKFSRHSQGLRILGYTLKSCASELGFLLFSLTMAIIIFATVMFYAEKGTNKTNFTSIPAAFWYTIVTMTTLGYGDMVPSTIAGKIFGSICSLSGVLVIALPVPVIVSNFSRIYHQNQRADKRRAQQKVRLARIRLAKSGTTNAFLQYKQNGGLEDSGSGEEQALCVRNRSAFEQQHHHLLHCLEKTTCHEFTDELTFSEALGAVSPGGRTSRSTSVSSQPVGPGSLLSSCCPRRAKRRAIRLANSTASVSRGSMQELDMLAGLRRSHAPQSRSSLNAKPHDSLDLNCDSRDFVAAIISIPTPPANTPDESQPSSPGGGGRAGSTLRNSSLGTPCLFPETVKISSL

SEQ ID NO: 164 - protein, 630 aa, Homo sapiens
MAAGVAAWLPFARAAAIGWMPVASGPMPAPPRQERKRTQDALIVLNVSGTRFQTWQDTLERYPDTLLGSSERDFFYHPETQQYFFDRDPDIFRHILNFYRTGKLHYPRHECISAYDEELAFFGLIPEIIGDCCYEEYKDRRRENAERLQDDADTDTAGESALPTMTARQRVWRAFENPHTSTMALVFYYVTGFFIAVSVIANVVETVPCGSSPGHIKELPCGERYAVAFFCLDTACVMIFTVEYLLRLAAAPSRYRFVRSVMSIIDVVAILPYYIGLVMTDNEDVSGAFVTLRVFRVFRIFKFSRHSQGLRILGYTLKSCASELGFLLFSLTMAIIIFATVMFYAEKGSSASKFTSIPAAFWYTIVTMTTLGYGDMVPKTIAGKIFGSICSLSGVLVIALPVPVIVSNFSRIYHQNQRADKRRAQKKARLARIRAAKSGSANAYMQSKRNGLLSNQLQSSEDEQAFVSKSGSSFETQHHHLLHCLEKTTNHEFVDEQVFEESCMEVATVNRPSSHSPSLSSQQGVTSTCCSRRHKKTFRIPNANVSGSHQGSIQELSTIQIRCVERTPLSNSRSSLNAKMEECVKLNCEQPYVTTAIISIPTPPVTTPEGDDRPESPEYSGGNIVRVSAL

SEQ ID NO: 165 - protein, 655 aa, Homo sapiens
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTGLSYLVDDPLLSVRTSTIKNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSAL

SEQ ID NO: 166 - protein, 636 aa, Homo sapiens
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSAL

SEQ ID NO: 167 - protein, 494 aa, Homo sapiens
MDGSGERSLPEPGSQSSAASDDIEIVVNVGGVRQVLYGDLLSQYPETRLAELINCLAGGYDTIFSLCDDYDPGKREFYFDRDPDAFKCVIEVYYFGEVHMKKGICPICFKNEMDFWKVDLKFLDDCCKSHLSEKREELEEIARRVQLILDDLGVDAAEGRWRRCQKCVWKFLEKPESSCPARVVAVLSFLLILVSSVVMCMGTIPELQVLDAEGNRVEHPTLENVETACIGWFTLEYLLRLFSSPNKLHFALSFMNIVDVLAILPFYVSLTLTHLGARMMELTNVQQAVQALRIMRIARIFKLARHSSGLQTLTYALKRSFKELGLLLMYLAVGIFVFSALGYTMEQSHPETLFKSIPQSFWWAIITMTTVGYGDIYPKTTLGKLNAAISFLCGVIAIALPIHPIINNFVRYYNKQRVLETAAKHELELMELNSSSGGEGKTGGSRSDLDNLPPEPAGKEAPSCSSRLKLSHSDTFIPLLTEEKHHRTRLQSCK

SEQ ID NO: 168 - protein, 513 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQGHCSQMCHNVFIVESVCVGWFSLEFLLRLIQAPSKFAFLRSPLTLIDLVAILPYYITLLVDGAAAGRRKPGAGNSYLDKVGLVLRVLRALRILYVMRLARHSLGLQTLGLTARRCTREFGLLLLFLCVAIALFAPLLYVIENEMADSPEFTSIPACYWWAVITMTTVGYGDMVPRSTPGQVVALSSILSGILLMAFPVTSIFHTFSRSYLELKQEQERVMFRRAQFLIKTKSQLSVSQDSDILFGSASSDTRDNN

SEQ ID NO: 169 - protein, 466 aa, Homo sapiens
MEPWPCSPGGGGGTRARHVIINVGGCRVRLAWAALARCPLARLERLRACRGHDDLLRVCDDYDVSRDEFFFDRSPCAFRAIVALLRAGKLRLLRGPCALAFRDELAYWGIDEARLERCCLRRLRRREEEAAEARAGPTERGAQGSPARALGPRGRLQRGRRRLRDVVDNPHSGLAGKLFACVSVSFVAVTAVGLCLSTMPDIRAEEERGECSPKCRSLFVLETVCVAWFSFEFLLRSLQAESKCAFLRAPLNIIDILALLPFYVSLLLGLAAGPGGTKLLERAGLVLRLLRALRVLYVMRLARHSLGLRSLGLTMRRCAREFGLLLLFLCVAMALFAPLVHLAERELGARRDFSSVPASYWWAVISMTTVGYGDMVPRSLPGQVVALSSILSGILLMAFPVTSIFHTFSRSYSELKEQQQRAASPEPALQEDSTHSATATEDSSQGPDSAGLADDSADALWVRAGR

SEQ ID NO: 170 - protein, 466 aa, Homo sapiens; identical to SEQ ID NO: 169

SEQ ID NO: 171 - protein, 436 aa, Homo sapiens
MTFGRSGAASVVLNVGGARYSLSRELLKDFPLRRVSRLHGCRSERDVLEVCDDYDRERNEYFFDRHSEAFGFILLYVRGHGKLRFAPRMCELSFYNEMIYWGLEGAHLEYCCQRRLDDRMSDTYTFYSADEPGVLGRDEARPGGAEAAPSRRWLERMRRTFEEPTSSLAAQILASVSVVFVIVSMVVLCASTLPDWRNAAADNRSLDDRSRYSAGPGREPSGIIEAICIGWFTAECIVRFIVSKNKCEFVKRPLNIIDLLAITPYYISVLMTVFTGENSQLQRAGVTLRVLRMMRIFWVIKLARHFIGLQTLGLTLKRCYREMVMLLVFICVAMAIFSALSQLLEHGLDLETSNKDFTSIPAACWWVIISMTTVGYGDMYPITVPGRILGGVCVVSGIVLLALPITFIYHSFVQCYHELKFRSARYSRSLSTEFLN

SEQ ID NO: 172 - protein, 425 aa, Homo sapiens
MTFGRSGAASVVLNVGGARYSLSRELLKDFPLRRVSRLHGCRSERDVLEVCDDYDRERNEYFFDRHSEAFGFILLYVRGHGKLRFAPRMCELSFYNEMIYWGLEGAHLEYCCQRRLDDRMSDTYTFYSADEPGVLGRDEARPGGAEAAPSRRWLERMRRTFEEPTSSLAAQILASVSVVFVIVSMVVLCASTLPDWRNAAADNRSLDDRSRIIEAICIGWFTAECIVRFIVSKNKCEFVKRPLNIIDLLAITPYYISVLMTVFTGENSQLQRAGVTLRVLRMMRIFWVIKLARHFIGLQTLGLTLKRCYREMVMLLVFICVAMAIFSALSQLLEHGLDLETSNKDFTSIPAACWWVIISMTTVGYGDMYPITVPGRILGGVCVVSGIVLLALPITFIYHSFVQCYHELKFRSARYSRSLSTEFLN

SEQ ID NO: 173 - protein, 519 aa, Homo sapiens
MPMPSRDGGLHPRHHHYGSHSPWSQLLSSPMETPSIKGLYYRRVRKVGALDASPVDLKKEILINVGGRRYLLPWSTLDRFPLSRLSKLRLCRSYEEIVQLCDDYDEDSQEFFFDRSPSAFGVIVSFLAAGKLVLLQEMCALSFQEELAYWGIEEAHLERCCLRKLLRKLEELEELAKLHREDVLRQQRETRRPASHSSRWGLCMNRLREMVENPQSGLPGKVFACLSILFVATTAVSLCVSTMPDLRAEEDQGECSRKCYYIFIVETICVAWFSLEFCLRFVQAQDKCQFFQGPLNIIDILAISPYYVSLAVSEEPPEDGERPSGSSYLEKVGLVLRVLRALRILYVMRLARHSLGLQTLGLTVRRCTREFGLLLLFLAVAITLFSPLVYVAEKESGRVLEFTSIPASYWWAIISMTTVGYGDMVPRSVPGQMVALSSILSGILIMAFPATSIFHTFSHSYLELKKEQEQLQARLRHLQNTGPASECELLDPHVASEHELMNDVNDLILEGPALPIMHM

SEQ ID NO: 174 - protein, 676 aa, Homo sapiens [sequence omitted]

SEQ ID NO: 175 - protein, 872 aa, Homo sapiens [sequence omitted]

SEQ ID NO: 176 - protein, 872 aa, Homo sapiens [sequence omitted]

SEQ ID NO: 177 - protein, 641 aa, Homo sapiens
MAEAPPRRLGLGPPPGDAPRAELVALTAVQSEQGEAGGGGSPRRLGLLGSPLPPGAPLPGPGSGSGSACGQRSSAAHKRYRRLQNWVYNVLERPRGWAFVYHVFIFLLVFSCLVLSVLSTIQEHQELANECLLILEFVMIVVFGLEYIVRVWSAGCCCRYRGWQGRFRFARKPFCVIDFIVFVASVAVIAAGTQGNIFATSALRSMRFLQILRMVRMDRRGGTWKLLGSVVYAHSKELITAWYIGFLVLIFASFLVYLAEKDANSDFSSYADSLWWGTITLTTIGYGDKTPHTWLGRVLAAGFALLGISFFALPAGILGSGFALKVQEQHRQKHFEKRRMPAANLIQAAWRLYSTDMSRAYLTATWYYYDSILPSFSSRMGIKDRIRMGSSQRRTGPSKQHLAPPTMPTSPSSEQVGEATSPTKVQKSWSFNDRTRFRASLRLKPRTSAEDAPSEEVAEEKSYQCELTVDDIMPAVKTVIRSIRILKFLVAKRKFKETLRPYDVKDVIEQYSAGHLDMLGRIKSLQTRVDQIVGRGPGDRKAREKGDKGPSDAEVVDEISMMGRVVKVEKQVQSIEHKLDLLLGFYSRCLRSGTSASLGAVQVPLFDPDITSDYHSPVDHEDISVSAQTLSISRSVSTNMD

SEQ ID NO: 178 - protein, 695 aa, Homo sapiens [sequence omitted]

SEQ ID NO: 179 - protein, 932 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSSQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 180 - protein, 500 aa, Homo sapiens
MPSSGRALLDSPLDSGSLTSLDSSVFCSEGEGEPLALGDCFTVNVGGSRFVLSQQALSCFPHTRLGKLAVVVASYRRPGALAAVPSPLELCDDANPVDNEYFFDRSSQAFRYVLHYYRTGRLHVMEQLCALSFLQEIQYWGIDELSIDSCCRDRYFRRKELSETLDFKKDTEDQESQHESEQDFSQGPCPTVRQKLWNILEKPGSSTAARIFGVISIIFVVVSIINMALMSAELSWLDLQLLEILEYVCISWFTGEFVLRFLCVRDRCRFLRKVPNIIDLLAILPFYITLLVESLSGSQTTQELENVGRIVQVLRLLRALRMLKLGRHSTGLRSLGMTITQCYEEVGLLLLFLSVGISIFSTVEYFAEQSIPDTTFTSVPCAWWWATTSMTTVGYGDIRPDTTTGKIVAFMCILSGILVLALPIAIINDRFSACYFTLKLKEAAVRQREALKKLTKNIATDSYISVNLRDVYARSIMEMLRLKGRERASTRSSGGDDFWF

SEQ ID NO: 181 - protein, 545 aa, Homo sapiens
MLKQSERRRSWSYRPWNTTENEGSQHRRSICSLGARSGSQASIHGWTEGNYNYYIEEDEDGEEEDQWKDDLAEEDQQAGEVTTAKPEGPSDPPALLSTLNVNVGGHSYQLDYCELAGFPKTRLGRLATSTSRSRQLSLCDDYEEQTDEYFFDRDPAVFQLVYNFYLSGVLLVLDGLCPRRFLEELGYWGVRLKYTPRCCRICFEERRDELSERLKIQHELRAQAQVEEAEELFRDMRFYGPQRRRLWNLMEKPFSSVAAKAIGVASSTFVLVSVVALALNTVEEMQQHSGQGEGGPDLRPILEHVEMLCMGFFTLEYLLRLASTPDLRRFARSALNLVDLVAILPLYLQLLLECFTGEGHQRGQTVGSVGKVGQVLRVMRLMRIFRILKLARHSTGLRAFGFTLRQCYQQVGCLLLFIAMGIFTFSAAVYSVEHDVPSTNFTTIPHSWWWAAVSISTVGYGDMYPETHLGRFFAFLCIAFGIILNGMPISILYNKFSDYYSKLKAYEYTTIRRERGEVNFMQRARKKIAECLLGSNPQLTPRQEN

SEQ ID NO: 182 - protein, 526 aa, Homo sapiens
MLMLLVRGTHYENLRSKVVLPTPLGGRSTETFVSEFPGPDTGIRWRRSDEALRVNVGGVRRQLSARALARFPGTRLGRLQAAASEEQARRLCDDYDEAAREFYFDRHPGFFLSLLHFYRTGHLHVLDELCVFAFGQEADYWGLGENALAACCRARYLERRLTQPHAWDEDSDTPSSVDPCPDEISDVQRELARYGAARCGRLRRRLWLTMENPGYSLPSKLFSCVSISVVLASIAAMCIHSLPEYQAREAAAAVAAVAAGRSPEGVRDDPVLRRLEYFCIAWFSFEVSSRLLLAPSTRNFFCHPLNLIDIVSVLPFYLTLLAGVALGDQGGKEFGHLGKVVQVFRLMRIFRVLKLARHSTGLRSLGATLKHSYREVGILLLYLAVGVSVFSGVAYTAEKEEDVGFNTIPACWWWGTVSMTTVGYGDVVPVTVAGKLAASGCILGGILVVALPITIIFNKFSHFYRRQKALEAAVRNSNHQEFEDLLSSIDGVSEASLETSRETSQEGQSADLESQAPSEPPHPQMY

SEQ ID NO: 183 - protein, 477 aa, Homo sapiens
MTGQSLWDVSEANVEDGEIRINVGGFKRRLRSHTLLRFPETRLGRLLLCHSREAILELCDDYDDVQREFYFDRNPELFPYVLHFYHTGKLHVMAELCVFSFSQEIEYWGINEFFIDSCCSYSYHGRKVEPEQEKWDEQSDQESTTSSFDEILAFYNDASKFDGQPLGNFRRQLWLALDNPGYSVLSRVFSILSILVVMGSIITMCLNSLPDFQIPDSQGNPGEDPRFEIVEHFGIAWFTFELVARFAVAPDFLKFFKNALNLIDLMSIVPFYITLVVNLVVESTPTLANLGRVAQVLRLMRIFRILKLARHSTGLRSLGATLKYSYKEVGLLLLYLSVGISIFSVVAYTIEKEENEGLATIPACWWWATVSMTTVGYGDVVPGTTAGKLTASACILAGILVVVLPITLIFNKFSHFYRRQKQLESAMRSCDFGDGMKEVPSVNLRDYYAHKVKSLMASLTNMSRSSPSELSLNDSLR

SEQ ID NO: 184 - protein, 491 aa, Homo sapiens
MVFGEFFHRPGQDEELVNLNVGGFKQSVDQSTLLRFPHTRLGKLLTCHSEEAILELCDDYSVADKEYYFDRNPSLFRYVLNFYYTGKLHVMEELCVFSFCQEIEYWGINELFIDSCCSNRYQERKEENHEKDWDQKSHDVSTDSSFEESSLFEKELEKFDTLRFGQLRKKIWIRMENPAYCLSAKLIAISSLSVVLASIVAMCVHSMSEFQNEDGEVDDPVLEGVEIACIAWFTGELAVRLAAAPCQKKFWKNPLNIIDFVSIIPFYATLAVDTKEEESEDIENMGKVVQILRLMRIFRILKLARHSVGLRSLGATLRHSYHEVGLLLLFLSVGISIFSVLIYSVEKDDHTSSLTSIPICWWWATISMTTVGYGDTHPVTLAGKLIASTCIICGILVVALPITIIFNKFSKYYQKQKDIDVDQCSEDAPEKCHELPYFNIRDIYAQRMHTFITSLSSVGIVVSDPDSTDASSIEDNEDICNTTSLENCTAK

SEQ ID NO: 185 - protein, 989 aa, Homo sapiens
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEVSAFMGDPGKIGFADQIPPPLEGRESQGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 186 - protein, 611 aa, Homo sapiens
MPGGKRGLVAPQNTFLENIVRRSSESSFLLGNAQIVDWPVVYSNDGFCKLSGYHRADVMQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILDHLS

SEQ ID NO: 187 - protein, 624 aa, Homo sapiens
MQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILGKGDVFGDIFWKETTLAHACANVRALTYCDLHIIKREALLKVLDFYTAFANSFSRNLTLTCNLRKRGWFSMANAL

SEQ ID NO: 188 - protein, 1159 aa, Homo sapiens
MPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 189 - protein, 888 aa, Homo sapiens
MPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGMGWGAGTGLEMPSAASRGASLLNMQSLGLWTWDCLQGHWAPLIHLNSGPPSGAMERSPTWGEAAELWGSHILLPFRIRHKQTLFASLK

SEQ ID NO: 190 - protein, 819 aa, Homo sapiens
MAAPAGKASRTGALRPRAQKGRVRRAVRISSLVAQEVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 191 - protein, 994 aa, Homo sapiens
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACIWYAIGNVERPYLEHKIGWLDSLGVQLGKRYNGSDPASGPSVQDKYVTALYFTFSSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSGSPHELGPQFPSKGYSLLGPGSQNSMGAGPCAPGHPDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 192 - protein, 905 aa, Homo sapiens
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACICSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 193 - protein, 732 aa, Homo sapiens
MPVRRGHVAPQNTFLGTIIRKFEGQNKKFIIANARVQNCAIIYCNDGFCEMTGFSRPDVMQKPCTCDFLHGPETKRHDIAQIAQALLGSEERKVEVTYYHKNGSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVCMSVFQNESAAGIIVIAKME

SEQ ID NO: 194 - protein, 1196 aa, Homo sapiens
MPVRRGHVAPQNTFLGTIIRKFEGQNKKFIIANARVQNCAIIYCNDGFCEMTGFSRPDVMQKPCTCDFLHGPETKRHDIAQIAQALLGSEERKVEVTYYHKNGSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEDNGRNVKGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVLKGFPECLQADICLHLNQTLLQNCKAFRGASKGCLRALAMKFKTTHAPPGDTLVHCGDVLTALYFLSRGSIEILKDDIVVAILGKNDIFGEMVHLYAKPGKSNADVRALTYCDLHKIQREDLLEVLDMYPEFSDHFLTNLELTFNLRHESAKADLLRSQSMNDSEGDNCKLRRRKLSFESEGEKENSTNDPEDSADTIRHYQSSKRHFEEKKSRSSSFISSIDDEQKPLFSGIVDSSPGIGKASGLDFEETVPTSGRMHIDKRSHSCKDITDMRSWERENAHPQPEDSSPSALQRAAWGISETESDLTYGEVEQRLDLLQEQLNRLESQMTTDIQTILQLLQKQTTVVPPAYSMVTAGSEYQRPIIQLMRTSQPEASIKTDRSFSPSSQCPEFLDLEKSKLKSKESLSSGVHLNTASEDNLTSLLKQDSDLSLELHLRQRKTYVHPIRHPSLPDSSLSTVGIVGLHRHVSDPGLPGK

SEQ ID NO: 195 - protein, 1107 aa, Homo sapiens
MPVMKGLLAPQNTFLDTIATRFDGTHSNFILANAQVAKGFPIVYCSDGFCELAGFARTEVMQKSCSCKFLFGVETNEQLMLQIEKSLEEKTEFKGEIMFYKKNGSPFWCLLDIVPIKNEKGDVVLFLASFKDITDTKVKITPEDKKEDKVKGRSRAGTHFDSARRRSRAVLYHISGHLQRREKNKLKINNNVFVDKPAFPEYKVSDAKKSKFILLHFSTFKAGWDWLILLATFYVAVTVPYNVCFIGNDDLSTTRSTTVSDIAVEILFIIDIILNFRTTYVSKSGQVIFEARSICIHYVTTWFIIDLIAALPFDLLYAFNVTVVSLVHLLKTVRLLRLLRLLQKLDRYSQHSTIVLTLLMSMFALLAHWMACIWYVIGKMEREDNSLLKWEVGWLHELGKRLESPYYGNNTLGGPSIRSAYIAALYFTLSSLTSVGFGNVSANTDAEKIFSICTMLIGALMHALVFGNVTAIIQRMYSRWSLYHTRTKDLKDFIRVHHLPQQLKQRMLEYFQTTWSVNNGIDSNELLKDFPDELRSDITMHLNKEILQLSLFECASRGCLRSLSLHIKTSFCAPGEYLLRQGDALQAIYFVCSGSMEVLKDSMVLAILGKGDLIGANLSIKDQVIKTNADVKALTYCDLQCIILKGLFEVLDLYPEYAHKFVEDIQHDLTYNLREGHESDVISRLSNKSMVSQSEPKGNGNINKRLPSIVEDEEEEEEGEEEEAVSLSPICTRGSSSRNKKVGSNKAYLGLSLKQLASGTVPFHSPIRVSRSNSPKTKQEIDPPNHNKRKEKNLKLQLSTLNNAGPPDLSPRIVDGIEDGNSSEESQTFDFGSERIRSEPRISPPLGDPEIGAAVLFIKAEETKQQINKLNSEVTTLTQEVSQLGKDMRNVIQLLENVLSPQQPSRFCSLHSTSVCPSRESLQTRTSWSAHQPCLHLQTGGAAYTQAQLCSSNITSDIWSVDPSSVGSSPQRTGAHEQNPADSELYHSPSLDYSPSHYQVVQEGHLQFLRCISPHSDSTLTPLQSISATLSSSVCSSSETSLHLVLPSRSEEGSFSQGTVSSFSLENLPGSWNQEGMASASTKPLENLPLEVVTSTAEVKDNKAINV

SEQ ID NO: 196 - protein, 1083 aa, Homo sapiens
MPAMRGLLAPQNTFLDTIATRFDGTHSNFVLGNAQVAGLFPVVYCSDGFCDLTGFSRAEVMQRGCACSFLYGPDTSELVRQQIRKALDEHKEFKAELILYRKSGLPFWCLLDVIPIKNEKGEVALFLVSHKDISETKNRGGPDRWKETGGGRRRYGRARSKGFNANRRRSRAVLYHLSGHLQKQPKGKHKLNKGVFGEKPNLPEYKVAAIRKSPFILLHCGALRATWDGFILLATLYVAVTVPYSVCVSTAREPSAARGPPSVCDLAVEVLFILDIVLNFRTTFVSKSGQVVFAPKSICLHYVTTWFLLDVIAALPFDLLHAFKVNVYFGAHLLKTVRLLRLLRLLPRLDRYSQYSAVVLTLLMAVFALLAHWVACVWFYIGQREIESSESELPEIGWLQELARRLETPYYLVGRRPAGGNSSGQSDNCSSSSEANGTGLELLGGPSLRSAYITSLYFALSSLTSVGFGNVSANTDTEKIFSICTMLIGALMHAVVFGNVTAIIQRMYARRFLYHSRTRDLRDYIRIHRIPKPLKQRMLEYFQATWAVNNGIDTTELLQSLPDELRADIAMHLHKEVLQLPLFEAASRGCLRALSLALRPAFCTPGEYLIHQGDALQALYFVCSGSMEVLKGGTVLAILGKGDLIGCELPRREQVVKANADVKGLTYCVLQCLQLAGLHDSLALYPEFAPRFSRGLRGELSYNLGAGGGSAEVDTSSLSGDNTLMSTLEEKETDGEQGPTVSPAPADEPSSPLLSPGCTSSSSAAKLLSPRRTAPRPRLGGRGRPGRAGALKAEAGPSAPPRALEGLRLPPMPWNVPPDLSPRVVDGIEDGCGSDQPKFSFRVGQSGPECSSSPSPGPESGLLTVPHGPSEARNTDTLDKLRQAVTELSEQVLQMREGLQSLRQAVQLVLAPHREGPCPRASGEGPCPASTSGLLQPLCVDTGASSYCLQPPAGSVLSGTWPHPRPGPPPLMAPWPWGPPASQSSPWPRATAFWTSTSDSEPPASGDLCSEPSTPASPPPSEEGARTGPAEPVSQAEATSTGEPPPGSGGLALPWDPHSLEMVLIGCHGSGTVQWTQEEGTGV

SEQ ID NO: 197 - protein, 1017 aa, Homo sapiens
MPVMKGLLAPQNTFLDTIATRFDGTHSNFLLANAQGTRGFPIVYCSDGFCELTGYGRTEVMQKTCSCRFLYGPETSEPALQRLHKALEGHQEHRAEICFYRKDGSAFWCLLDMMPIKNEMGEVVLFLFSFKDITQSGSPGLGPQGGRGDSNHENSLGRRGATWKFRSARRRSRTVLHRLTGHFGRRGQGGMKANNNVFEPKPSVPEYKVASVGGSRCLLLHYSVSKAIWDGLILLATFYVAVTVPYNVCFSGDDDTPITSRHTLVSDIAVEMLFILDIILNFRTTYVSQSGQVISAPRSIGLHYLATWFFIDLIAALPFDLLYIFNITVTSLVHLLKTVRLLRLLRLLQKLERYSQCSAVVLTLLMSVFALLAHWMACIWYVIGRREMEANDPLLWDIGWLHELGKRLEVPYVNGSVGGPSRRSAYIAALYFTLSSLTSVGFGNVCANTDAEKIFSICTMLIGALMHAVVFGNVTAIIQRMYSRRSLYHSRMKDLKDFIRVHRLPRPLKQRMLEYFQTTWAVNSGIDANELLRDFPDELRADIAMHLNREILQLPLFGAASRGCLRALSLHIKTSFCAPGEYLLRRGDALQAHYYVCSGSLEVLRDNMVLAILGKGDLIGADIPEPGQEPGLGADPNFVLKTSADVKALTYCGLQQLSSRGLAEVLRLYPEYGAAFRAGLPRDLTFNLRQGSDTSGLSRFSRSPRLSQPRSESLGSSSDKTLPSITEAESGAEPGGGPRPRRPLLLPNLSPARPRGSLVSLLGEELPPFSALVSSPSLSPSLSPALAGQGHSASPHGPPRCSAAWKPPQLLIPPLGTFGPPDLSPRIVDGIEDSGSTAEAPSFRFSRRPELPRPRSQAPPTGTRPSPELASEAEEVKEKVCRLNQEISRLNQEVSQLSRELRHIMGLLQARLGPPGHPAGSAWTPDPPCPQLRPPCLSPCASRPPPSLQDTTLAEVHCPASVGTMETGTALLDLRPSILPPYPSEPDPLGPSPVPEASPPTPSLLRHSFQSRSDTFH

SEQ ID NO: 198 - protein, 1182 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRSRKRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 199 - protein, 543 aa, Homo sapiens
MNSHSYNGSVGRPLGSGPGALGRDPPDPEAGHPPQPPHSPGLQVVVAKSEPARPSPGSPRGQPQDQDDDEDDEEDEAGRQRASGKPSNVGHRLGHRRALFEKRKRLSDYALIFGMFGIVVMVTETELSWGVYTKESLYSFALKCLISLSTAILLGLVVLYHAREIQLFMVDNGADDWRIAMTCERVFLISLELAVCAIHPVPGHYRFTWTARLAFTYAPSVAEADVDVLLSIPMFLRLYLLGRVMLLHSKIFTDASSRSIGALNKITFNTRFVMKTLMTICPGTVLLVFSISSWIIAAWTVRVCERYHDKQEVTSNFLGAMWLISITFLSIGYGDMVPHTYCGKGVCLLTGIMGAGCTALVVAVVARKLELTKAEKHVHNFMMDTQLTKRVKNAAANVLRETWLIYKHTRLVKKPDQARVRKHQRKFLQAIHQAQKLRSVKIEQGKLNDQANTLTDLAKTQTVMYDLVSELHAQHEELEARLATLESRLDALGASLQALPGLIAQAIRPPPPPLPPRPGPGPQDQAARSSPCRWTPVAPSDCG

SEQ ID NO: 200 - protein, 231 aa, Homo sapiens
MWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 201 - protein, 579 aa, Homo sapiens
MSSCRYNGGVMRPLSNLSASRRNLHEMDSEAQPLQPPASVGGGGGASSPSAAAAAAAAVSSSAPEIVVSKPEHNNSNNLALYGTGGGGSTGGGGGGGGSGHGSSSGTKSSKKKNQNIGYKLGHRRALFEKRKRLSDYALIFGMFGIVVMVIETELSWGAYDKASLYSLALKCLISLSTIILLGLIIVYHAREIQLFMVDNGADDWRIAMTYERIFFICLEILVCAIHPIPGNYTFTWTARLAFSYAPSTTTADVDIILSIPMFLRLYLIARVMLLHSKLFTDASSRSIGALNKINFNTRFVMKTLMTICPGTVLLVFSISLWIIAAWTVRACERYHDQQDVTSNFLGAMWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 202 - protein, 426 aa, Homo sapiens
MERPIKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 203 - protein, 731 aa, Homo sapiens
MDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 204 - protein, 427 aa, Homo sapiens
MGGDLVLGLGALRRRKRLLEQEKSLAGWALVLAGTGIGLMVLHAEMLWFGGCSWALYLFLVKCTISISTFLLLCLIVAFHAKEVQLFMTDNGLRDWRVALTGRQAAQIVLELVVCGLHPAPVRGPPCVQDLGAPLTSPQPWPGFLGQGEALLSLAMLLRLYLVPRAVLLRSGVLLNASYRSIGALNQVRFRHWFVAKLYMNTHPGRLLLGLTLGLWLTTAWVLSVAERQAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 205 - protein, 1235 aa, Homo sapiens
MPLPDGARTPGGVCREARGGGYTNRTFEFDDGQCAPRRPCAGDGALLDTAGFKMSDLDSEVLPLPPRYRFRDLLLGDPSFQNDDRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYDEMNDHQNTLSYVLINPPPDTRLEPSDIVYLIRSDPLAHVASSSQSRKSSCSHKLSSCNPETRDETQL

SEQ ID NO: 206 - protein, 1135 aa, Homo sapiens
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPPDMHFLDAICWFPMVYYMVGSIDNLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 207 - protein, 1149 aa, Homo sapiens
MFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLVILVFVLSIGSLIIYFINSADPVGSCSSYEDKTIPIDLVFNAFFSFYFGLRFMAADDKIKFWLEMNSIVDIFTIPPTFISYYLKSNWLGLRFLRALRLLELPQILQILRAIKTSNSVKFSKLLSIILSTWFTAAGFIHLVENSGDPWLKGRNSQNISYFESIYLVMATTSTVGFGDVVAKTSLGRTFIMFFTLGSLILFANYIPEMVELFANKRKYTSSYEALKGKKFIVVCGNITVDSVTAFLRNFLRDKSGEINTEIVFLGETPPSLELETIFKCYLAYTTFISGSAMKWEDLRRVAVESAEACLIIANPLCSDSHAEDISNIMRVLSIKNYDSTTRIIIQILQSHNKVYLPKIPSWNWDTGDNIICFAELKLGFIAQGCLVPGLCTFLTSLFVEQNKKVMPKQTWKKHFLNSMKNKILTQRLSDDFAGMSFPEVARLCFLKMHLLLIAIEYKSLFTDGFCGLILNPPPQVRIRKNTLGFFIAETPKDVRRALFYCSVCHDDVFIPELITNCGCKSRSRQHITVPSVKRMKKCLKGISSRISGQDSPPRVSASTSSISNFTTRTLQHDVEQDSDQLDSSGMFHWCKPTSLDKVTLKRTGKSKYKFRNHIVACVFGDAHSAPMGLRNFVMPLRASNYTRKELKDIVFIGSLDYLQREWRFLWNFPQIYILPGCALYSGDLHAANIEQCSMCAVLSPPPQPSSNQTLVDTEAIMATLTIGSLQIDSSSDPSPSVSEETPGYTNGHNEKSNCRKVPILTELKNPSNIHFIEQLGGLEGSLQETNLHLSTAFSTGTVFSGSFLDSLLATAFYNYHVLELLQMLVTGGVSSQLEQHLDKDKVYGVADSCTSLLSGRNRCKLGLLSLHETILSDVNPRNTFGQLFCGSLDLFGILCVGLYRIIDEEELNPENKRFVITRPANEFKLLPSDLVFCAIPFSTACYKRNEEFSLQKSYEIVNKASQTTETHSDTNCPPTIDSVTETLYSPVYSYQPRTNSLSFPKQIAWNQSRTNSIISSQIPLGDNAKENERKTSDEVYDEDPFAYSEPL

SEQ ID NO: 208 - protein, 372 aa, Homo sapiens
MFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 209 - protein, 391 aa, Homo sapiens
MNASSRNVFDTLIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 210 - protein, 427 aa, Homo sapiens
MGSVRTNRYSIVSSEEDGMKLATMAVANGFGNGKSKVHTRQQCRSRFVKKDGHCNVQFINVGEKGQRYLADIFTTCVDIRWRWMLVIFCLAFVLSWLFFGCVFWLIALLHGDLDASKEGKACVSEVNSFTAAFLFSIETQTTIGYGFRCVTDECPIAVFMVVFQSIVGCIIDAFIIGAVMAKMAKPKKRNETLVFSHNAVIAMRDGKLCLMWRVGNLRKSHLVEAHVRAQLLKSRITSEGEYIPLDQIDINVGFDSGIDRIFLVSPITIVHEIDEDSPLYDLSKQDIDNADFEIVVILEGMVEATAMTTQCRSSYLANEILWGHRYEPVLFEEKHYYKVDYSRFHKTYEVPNTPLCSARDLAEKKYILSNANSFCYENEVALTSKEEDDSENGVPESTSTDTPPDIDLHNQASVPLEPRPLRRESEI

SEQ ID NO: 211 - protein, 433 aa, Homo sapiens
MTAASRANPYSIVSSEEDGLHLVTMSGANGFGNGKVHTRRRCRNRFVKKNGQCNIEFANMDEKSQRYLADMFTTCVDIRWRYMLLIFSLAFLASWLLFGIIFWVIAVAHGDLEPAEGRGRTPCVMQVHGFMAAFLFSIETQTTIGYGLRCVTEECPVAVFMVVAQSIVGCIIDSFMIGAIMAKMARPKKRAQTLLFSHNAVVALRDGKLCLMWRVGNLRKSHIVEAHVRAQLIKPRVTEEGEYIPLDQIDIDVGFDKGLDRIFLVSPITILHEIDEASPLFGISRQDLETDDFEIVVILEGMVEATAMTTQARSSYLANEILWGHRFEPVLFEEKNQYKIDYSHFHKTYEVPSTPRCSAKDLVENKFLLPSANSFCYENELAFLSRDEEDEADGDQDGRSRDGLSPQARHDFDRLQAGGGVLEQRPYRRESEI

SEQ ID NO: 212 - protein, 445 aa, Homo sapiens
MHGHSRNGQAHVPRRKRRNRFVKKNGQCNVYFANLSNKSQRYMADIFTTCVDTRWRYMLMIFSAAFLVSWLFFGLLFWCIAFFHGDLEASPGVPAAGGPAAGGGGAAPVAPKPCIMHVNGFLGAFLFSVETQTTIGYGFRCVTEECPLAVIAVVVQSIVGCVIDSFMIGTIMAKMARPKKRAQTLLFSHHAVISVRDGKLCLMWRVGNLRKSHIVEAHVRAQLIKPYMTQEGEYLPLDQRDLNVGYDIGLDRIFLVSPIIIVHEIDEDSPLYGMGKEELESEDFEIVVILEGMVEATAMTTQARSSYLASEILWGHRFEPVVFEEKSHYKVDYSRFHKTYEVAGTPCCSARELQESKITVLPAPPPPPSAFCYENELALMSQEEEEMEEEAAAAAAVAAGLGLEAGSKEEAGIIRMLEFGSHLDLERMQASLPLDNISYRRESAI

SEQ ID NO: 213 - protein, 436 aa, Homo sapiens
MGLARALRRLSGALDSGDSRAGDEEEAGPGLCRNGWAPAPVQSPVGRRRGRFVKKDGHCNVRFVNLGGQGARYLSDLFTTCVDVRWRWMCLLFSCSFLASWLLFGLAFWLIASLHGDLAAPPPPAPCFSHVASFLAAFLFALETQTSIGYGVRSVTEECPAAVAAVVLQCIAGCVLDAFVVGAVMAKMAKPKKRNETLVFSENAVVALRDHRLCLMWRVGNLRRSHLVEAHVRAQLLQPRVTPEGEYIPLDHQDVDVGFDGGTDRIFLVSPITIVHEIDSASPLYELGRAELARADFELVVILEGMVEATAMTTQCRSSYLPGELLWGHRFEPVLFQRGSQYEVDYRHFHRTYEVPGTPVCSAKELDERAEQASHSLKSSFPGSLTAFCYENELALSCCQEEDEDDETEEGNGVETEDGAASPRVLTPTLALTLPP

SEQ ID NO: 214 - protein, 501 aa, Homo sapiens
MSALRRKFGDDYQVVTTSSSGSGLQPQGPGQDPQQQLVPKKKRQRFVDKNGRCNVQHGNLGSETSRYLSDLFTTLVDLKWRWNLFIFILTYTVAWLFMASMWWVIAYTRGDLNKAHVGNYTPCVANVYNFPSAFLFFIETEATIGYGYRYITDKCPEGIILFLFQSILGSIVDAFLIGCMFIKMSQPKKRAETLMFSEHAVISMRDGKLTLMFRVGNLRNSHMVSAQIRCKLLKSRQTPEGEFLPLDQLELDVGFSTGADQLFLVSPLTICHVIDAKSPFYDLSQRSMQTEQFEIVVILEGIVETTGMTCQARTSYTEDEVLWGHRFFPVISLEEGFFKVDYSQFHATFEVPTPPYSVKEQEEMLLMSSPLIAPAITNSKERHNSVECLDGLDDITTKLPSKLQKITGREDFPKKLLRMSSTTSEKAYSLGDLPMKLQRISSVPGNSEEKLVSKTTKMLSDPMSQSVADLPPKLQKMAGGAARMEGNLPAKLRKMNSDRFT

SEQ ID NO: 215 - protein, 423 aa, Homo sapiens
MAKLTESMTNVLEGDSMDQDVESPVAIHQPKLPKQARDDLPRHISRDRTKRKIQRYVRKDGKCNVHHGNVRETYRYLTDIFTTLVDLKWRFNLLIFVMVYTVTWLFFGMIWWLIAYIRGDMDHIEDPSWTPCVTNLNGFVSAFLFSIETETTIGYGYRVITDKCPEGIILLLIQSVLGSIVNAFMVGCMFVKISQPKKRAETLVFSTHAVISMRDGKLCLMFRVGDLRNSHIVEASIRAKLIKSKQTSEGEFIPLNQTDINVGYYTGDDRLFLVSPLIISHEINQQSPFWEISKAQLPKEELEIVVILEGMVEATGMTCQARSSYITSEILWGYRFTPVLTLEDGFYEVDYNSFHETYETSTPSLSAKELAELASRAELPLSWSVSSKLNQHAELETEEEEKNLEEQTERNGDVANLENESKV

SEQ ID NO: 216 - protein, 393 aa, Homo sapiens
MAQENAAFSPGQEEPPRRRGRQRYVEKDGRCNVQQGNVRETYRYLTDLFTTLVDLQWRLSLLFFVLAYALTWLFFGAIWWLIAYGRGDLEHLEDTAWTPCVNNLNGFVAAFLFSIETETTIGYGHRVITDQCPEGIVLLLLQAILGSMVNAFMVGCMFVKISQPNKRAATLVFSSHAVVSLRDGRLCLMFRVGDLRSSHIVEASIRAKLIRSRQTLEGEFIPLHQTDLSVGFDTGDDRLFLVSPLVISHEIDAASPFWEASRRALERDDFEIVVILEGMVEATGMTCQARSSYLVDEVLWGHRFTSVLTLEDGFYEVDYASFHETFEVPTPSCSARELAEAAARLDAHLYWSIPSRLDEKVEEEGAGEGAGGEAGADKEQNGCLPPPESESKV

SEQ ID NO: 217 - protein, 419 aa, Homo sapiens
MAGDSRNAMNQDMEIGVTPWDPKKIPKQARDYVPIATDRTRLLAEGKKPRQRYMEKSGKCNVHHGNVQETYRYLSDLFTTLVDLKWRFNLLVFTMVYTVTWLFFGFIWWLIAYIRGDLDHVGDQEWIPCVENLSGFVSAFLFSIETETTIGYGFRVITEKCPEGIILLLVQAILGSIVNAFMVGCMFVKISQPKKRAETLMFSNNAVISMRDEKLCLMFRVGDLRNSHIVEASIRAKLIKSRQTKEGEFIPLNQTDINVGFDTGDDRLFLVSPLIISHEINQKSPFWEMSQAQLHQEEFEVVVILEGMVEATGMTCQARSSYMDTEVLWGHRFTPVLTLEKGFYEVDYNTFHDTYETNTPSCCAKELAEMKREGRLLQYLPSPPLLGGCAEAGLDAEAEQNEEDEPKGLGGSREARGSV

SEQ ID NO: 218 - protein, 379 aa, Homo sapiens
MTSVAKVYYSQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQVNVTFQVDTASDSPFLILPLTFYHVVDETSPLKDLPLRSGEGDFELVLILSGTVESTSATCQVRTSYLPEEILWGYEFTPAISLSASGKYIADFSLFDQVVKVASPSGLRDSTVRYGDPEKLKLEESLREQAEKEGSALSVRISNV

SEQ ID NO: 219 - protein, 375 aa, Homo sapiens
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLIEIFITGTFLAKIARPKKRAETIKFSHCAVITKQNGKLCLVIQVANMRKSLLIQCQLSGKLLQTHVTKEGERILLNQATVKFHVDSSSESPFLILPMTFYHVLDETSPLRDLTPQNLKEKEFELVVLLNATVESTSAVCQSRTSYIPEEIYWGFEFVPVVSLSKNGKYVADFSQFEQIRKSPDCTFYCADSEKQQLEEKYRQEDQRERELRTLLLQQSNV

SEQ ID NO: 220 - protein, 418 aa, Homo sapiens
MSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 221 - protein, 424 aa, Homo sapiens
MLARKSIIPEEYVLARIAAENLRKPRIRDRLPKARFIAKSGACNLAHKNIREQGRFLQDIFTTLVDLKWRHTLVIFTMSFLCSWLLFAIMWWLVAFAHGDIYAYMEKSGMEKSGLESTVCVTNVRSFTSAFLFSIEVQVTIGFGGRMMTEECPLAITVLILQNIVGLIINAVMLGCIFMKTAQAHRRAETLIFSRHAVIAVRNGKLCFMFRVGDLRKSMIISASVRIQVVKKTTTPEGEVVPIHQLDIPVDNPIESNNIFLVAPLIICHVIDKRSPLYDISATDLANQDLEVIVILEGVVETTGITTQARTSYIAEEIQWGHRFVSIVTEEEGVYSVDYSKFGNTVKVAAPRCSARELDEKPSILIQTLQKSELSHQNSLRKRNSMRRNNSMRRNNSIRRNNSSLMVPKVQFMTPEGNQNTSES

SEQ ID NO: 222 - protein, 390 aa, Homo sapiens
MLSRKGIIPEEYVLTRLAEDPAKPRYRARQRRARFVSKKGNCNVAHKNIREQGRFLQDVFTTLVDLKWPHTLLIFTMSFLCSWLLFAMAWWLIAFAHGDLAPSEGTAEPCVTSIHSFSSAFLFSIEVQVTIGFGGRMVTEECPLAILILIVQNIVGLMINAIMLGCIFMKTAQAHRRAETLIFSKHAVIALRHGRLCFMLRVGDLRKSMIISATIHMQVVRKTTSPEGEVVPLHQVDIPMENGVGGNSIFLVAPLIIYHVIDANSPLYDLAPSDLHHHQDLEIIVILEGVVETTGITTQARTSYLADEILWGQRFVPIVAEEDGRYSVDYSKFGNTVKVPTPLCTARQLDEDHSLLEALTLASARGPLRKRSVPMAKAKPKFSISPDSLS

SEQ ID NO: 223 - protein, 360 aa, Homo sapiens
MDSSNCKVIAPLLSQRYRRMVTKDGHSTLQMDGAQRGLAYLRDAWGILMDMRWRWMMLVFSASFVVHWLVFAVLWYVLAEMNGDLELDHDAPPENHTICVKYITSFTAAFSFSLETQLTIGYGTMFPSGDCPSAIALLAIQMLLGLMLEAFITGAFVAKIARPKNRAFSIRFTDTAVVAHMDGKPNLIFQVANTRPSPLTSVRVSAVLYQERENGKLYQTSVDFHLDGISSDECPFFIFPLTYYHSITPSSPLATLLQHENPSHFELVVFLSAMQEGTGEICQRRTSYLPSEIMLHHCFASLLTRGSKGEYQIKMENFDKTVPEFPTPLVSKSPNRTDLDIHINGQSIDNFQISETGLTE

SEQ ID NO: 224 - protein, 336 aa, Homo sapiens
MLQSLAGSSCVRLVERHRSAWCFGFLVLGYLLYLVFGAVVFSSVELPYEDLLRQELRKLKRRFLEEHECLSEQQLEQFLGRVLEASNYGVSVLSNASGNWNWDFTSALFFASTVLSTTGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 225 - protein, 422 aa, Homo sapiens
MMNPRAKRDFYLAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 226 - protein, 394 aa, Homo sapiens
MKRQNVRTLALIVCTFTYLLVGAAVFDALESEPELIERQRLELRQQELRARYNLSQGGYEELERVVLRLKPHKAGVQWRFAGSFYFAITVITTIGYGHAAPSTDGGKVFCMFYALLGIPLTLVMFQSLGERINTLVRYLLHRAKKGLGMRRADVSMANMVLIGFFSCISTLCIGAAAFSHYEHWTFFQAYYYCFITLTTIGFGDYVALQKDQALQTQPQYVAFSFVYILTGLTVIGAFLNLVVLRFMTMNAEDEKRDAEHRALLTRNGQAGGGGGGGSAHTTDTASSTAAAGGGGFRNVYAEVLHFQSMCSCLWYKSREKLQYSIPMIIPRDLSTSDTCVEQSHSSPGGGGRYSDTPSRRCLCSGAPRSAISSVSTGLHSLSTFRGLMKRRSSV

SEQ ID NO: 227 - protein, 393 aa, Homo sapiens
MRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPV

SEQ ID NO: 228 - protein, 499 aa, Homo sapiens
MVDRGPLLTSAIIFYLAIGAAIFEVLEEPHWKEAKKNYYTQKLHLLKEFPCLGQEGLDKILEVVSDAAGQGVAITGNQTFNNWNWPNAMIFAATVITTIGYGNVAPKTPAGRLFCVFYGLFGVPLCLTWISALGKFFGGRAKRLGQFLTKRGVSLRKAQITCTVIFIVWGVLVHLVIPPFVFMVTEGWNYIEGLYYSFITISTIGFGDFVAGVNPSANYHALYRYFVELWIYLGLAWLSLFVNWKVSMFVEVHKAIKKRRRRRKESFESSPHSRKALQVKGSTASKDVNIFSFLSKKEETYNDLIKQIGKKAMKTSGGGETGPGPGLGPQGGGLPALPPSLVPLVVYSKNRVPTLEEVSQTLRSKGHVSRSPDEEAVARAPEDSSPAPEVFMNQLDRISEECEPWDAQDYHPLIFQDASITFVNTEAGLSDEETSKSSLEDNLAGEESPQQGAEAKAPLNMGEFPSSSESTFTSTESELSVPYEQLMNEYNKANSPKGT

SEQ ID NO: 229 - protein, 313 aa, Homo sapiens
MRRGALLAGALAAYAAYLVLGALLVARLEGPHEARLRAELETLRAQLLQRSPCVAAPALDAFVERVLAAGRLGRVVLANASGSANASDPAWDFASALFFASTLITTVGYGYTTPLTDAGKAFSIAFALLGVPTTMLLLTASAQRLSLLLTHVPLSWLSMRWGWDPRRAACWHLVALLGVVVTVCFLVPAVIFAHLEEAWSFLDAFYFCFISLSTIGLGDYVPGEAPGQPYRALYKVLVTVYLFLGLVAMVLVLQTFRHVSDLHGLTELILLPPPCPASFNADEDDRVDILGPQPESHQQLSASSHTDYASIPR

SEQ ID NO: 230 - protein, 307 aa, Homo sapiens
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGYLLLGLLAMLLAVETFSELPQVRAMGKFFRPSGPVTAEDQGGILGQDELALSTLPPAAPASGQAPAC

SEQ ID NO: 231 - protein, 374 aa, Homo sapiens
MKRQNVRTLSLIVCTFTYLLVGAAVFDALESDHEMREEEKLKAEEIRIKGKYNISSEDYRQLELVILQSEPHRAGVQWKFAGSFYFAITVITTIGYGHAAPGTDAGKAFCMFYAVLGIPLTLVMFQSLGERMNTFVRYLLKRIKKCCGMRNTDVSMENMVTVGFFSCMGTLCIGAAAFSQCEEWSFFHAYYYCFITLTTIGFGDYVALQTKGALQKKPLYVAFSFMYILVGLTVIGAFLNLVVLRFLTMNSEDERRDAEERASLAGNRNSMVIHIPEEPRPSRPRYKADVPDLQSVCSCTCYRSQDYGGRSVAPQNSFSAKLAPHYFHSISYKIEEISPSTLKNSLFPSPISSISPGLHSFTDHQRLMKRRKSV

SEQ ID NO: 232 - protein, 538 aa, Homo sapiens
MFFLYTDFFLSLVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 233 - protein, 430 aa, Homo sapiens
MSSRSPRPPPRRSRRRLPRPSCCCCCCRRSHLNEDTGRFVLLAALIGLYLVAGATVFSALESPGEAEARARWGATLRNFSAAHGVAEPELRAFLRHYEAALAAGVRADALRPRWDFPGAFYFVGTVVSTIGFGMTTPATVGGKAFLIAYGLFGCAGTILFFNLFLERIISLLAFIMRACRERQLRRSGLLPATFRRGSALSEADSLAGWKPSVYHVLLILGLFAVLLSCCASAMYTSVEGWDYVDSLYFCFVTFSTIGFGDLVSSQHAAYRNQGLYRLGNFLFILLGVCCIYSLFNVISILIKQVLNWMLRKLSCRCCARCCPAPGAPLARRNAITPGSRLRRRLAALGADPAARDSDAEGRRLSGELISMRDLTASNKVSLALLQKQLSETANGYPRSVCVNTRQNGFSGGVGALGIMNNRLAETSASR

SEQ ID NO: 234 - protein, 408 aa, Homo sapiens
MAGRGFSWGPGHLNEDNARFLLLAALIVLYLLGGAAVFSALELAHERQAKQRWEERLANFSRGHNLSRDELRGFLRHYEEATRAGIRVDNVRPRWDFTGAFYFVGTVVSTIGFGMTTPATVGGKIFLIFYGLVGCSSTILFFNLFLERLITIIAYIMKSCHQRQLRRRGALPQESLKDAGQCEVDSLAGWKPSVYYVMLILCTASILISCCASAMYTPIEGWSYFDSLYFCFVAFSTIGFGDLVSSQNAHYESQGLYRFANFVFILMGVCCIYSLFNVISILIKQSLNWILRKMDSGCCPQCQRGLLRSRRNVVMPGSVRNRCNISIETDGVAESDTDGRRLSGEMISMKDLLAANKASLAILQKQLSEMANGCPHQTSTLARDNEFSGGVGAFAIMNNRLAETSGDR

SEQ ID NO: 235 - protein, 330 aa, Homo sapiens
MRRPSVRAAGLVLCTLCYLLVGAAVFDALESEAESGRQRLLVQKRGALRRKFGFSAEDYRELERLALQAEPHRAGRQWKFPGSFYFAITVITTIEYGHAAPGTDSGKVFCMFYALLGIPLTLVTFQSLGERLNAVVRRLLLAAKCCLGLRWTCVSTENLVVAGLLACAATLALGAVAFSHFEGWTFFHAYYYCFITLTTIGFGDFVALQSGEALQRKLPYVAFSFLYILLGLTVIGAFLNLVVLRFLVASADWPERAARTPSPRPPGAPESRGLWLPRRPARSVGSASVFCHVHKLERCARDNLGFSPPSSPGVVRGGQAPRLGARWKSI

SEQ ID NO: 236 - protein, 309 aa, Homo sapiens
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGTDPSKHYISVYRSLAAIWILLGLAWLALILPLGPLLLHRCCQLWLLSLRQGCGAKAAPGRRPRRGSTAARGVQVTPQDFPISKKGLGS

SEQ ID NO: 237 - protein, 332 aa, Homo sapiens
MYRPRARAAPEGRVRGCAVPSTVLLLLAYLAYLALGTGVFWTLEGRAAQDSSRSFQRDKWELLQNFTCLDRPALDSLIRDVVQAYKNGASLLSNTTSMGRWELVGSFFFSVSTITTIGYGNLSPNTMAARLFCIFFALVGIPLNLVVLNRLGHLMQQGVNHWASRLGGTWQDPDKARWLAGSGALLSGLLLFLLLPPLLFSHMEGWSYTEGFYFAFITLSTVGFGDYVIGMNPSQRYPLWYKNMVSLWILFGMAWLALIIKLILSQLETPGRVCSCCHHSSKEDFKSQSWRQGPDREPESHSPQQGCYPEGPMGIIQHLEPSAHAAGCGKDS

SEQ ID NO: 238 - protein, 384 aa, Homo sapiens
MEVSGHPQARRCCPEALGKLFPGLCFLCFLVTYALVGAVVFSAIEDGQVLVAADDGEFEKFLEELCRILNCSETVVEDRKQDLQGHLQKVKPQWFNRTTHWSFLSSLFFCCTVFSTVGYGYIYPVTRLGKYLCMLYALFGIPLMFLVLTDTGDILATILSTSYNRFRKFPFFTRPLLSKWCPKSLFKKKPDPKPADEAVPQIIISAEELPGPKLGTCPSRPSCSMELFERSHALEKQNTLQLPPQAMERSNSCPELVLGRLSYSIISNLDEVGQQVERLDIPLPIIALIVFAYISCAAAILPFWETQLDFENAFYFCFVTLTTIGFGDTVLEHPNFFLFFSIYIIVGMEIVFIAFKLVQNRLIDIYKNVMLFFAKGKFYHLVKK

SEQ ID NO: 239 - protein, 690 aa, Homo sapiens
MKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 240 - protein, 664 aa, Homo sapiens
MTEKTNGVKSSPANNHNHHAPPAIKANGKDDHRTSSRPHSAADDDTSSELQRLADVDAPQQGRSGFRRIVRLVGIIREWANKNFREEEPRPDSFLERFRGPELQTVTTQEGDGKGDKDGEDKGTKKKFELFVLDPAGDWYYCWLFVIAMPVLYNWCLLVARACFSDLQKGYYLVWLVLDYVSDVVYIADLFIRLRTGFLEQGLLVKDTKKLRDNYIHTLQFKLDVASIIPTDLIYFAVDIHSPEVRFNRLLHFARMFEFFDRTETRTNYPNIFRISNLVLYILVIIHWNACIYYAISKSIGFGVDTWVYPNITDPEYGYLAREYIYCLYWSTLTLTTIGETPPPVKDEEYLFVIFDFLIGVLIFATIVGNVGSMISNMNATRAEFQAKIDAVKHYMQFRKVSKGMEAKVIRWFDYLWTNKKTVDEREILKNLPAKLRAEIAINVHLSTLKKVRIFHDCEAGLLVELVLKLRPQVFSPGDYICRKGDIGKEMYIIKEGKLAVVADDGVTQYALLSAGSCFGEISILNIKGSKMGNRRTANIRSLGYSDLFCLSKDDLMEAVTEYPDAKKVLEERGREILMKEGLLDENEVATSMEVDVQEKLGQLETNMETLYTRFGRLLAEYTGAQQKLKQRITVLETKMKQNNEDDYLSDGMNSPELAAADEP

SEQ ID NO: 241 - protein, 676 aa, Homo sapiens
MAKINTQYSHPSRTHLKVKTSDRDLNRAENGLSRAHSSSEETSSVLQPGIAMETRGLADSGQGSFTGQGIARLSRLIFLLRRWAARHVHHQDQGPDSFPDRFRGAELKEVSSQESNAQANVGSQEPADRGRRKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 242 - protein, 575 aa, Homo sapiens
MSQDTKVKTTESSPPAPSKARKLLPVLDPSGDYYYWWLNTMVFPVMYNLIILVCRACFPDLQHGYLVAWLVLDYTSDLLYLLDMVVRFHTGFLEQGILVVDKGRISSRYVRTWSFFLDLASLMPTDVVYVRLGPHTPTLRLNRFLRAPRLFEAFDRTETRTAYPNAFRIAKLMLYIFVVIHWNSCLYFALSRYLGFGRDAWVYPDPAQPGFERLRRQYLYSFYFSTLILTTVGDTPPPAREEEYLFMVGDFLLAVMGFATIMGSMSSVIYNMNTADAAFYPDHALVKKYMKLQHVNRKLERRVIDWYQHLQINKKMTNEVAILQHLPERLRAEVAVSVHLSTLSRVQIFQNCEASLLEELVLKLQPQTYSPGEYVCRKGDIGQEMYIIREGQLAVVADDGITQYAVLGAGLYFGEISIINIKGNMSGNRRTANIKSLGYSDLFCLSKEDLREVLSEYPQAQTIMEEKGREILLKMNKLDVNAEAAEIALQEATESRLRGLDQQLDDLQTKFARLLAELESSALKIAYRIERLEWQTREWPMPEDLAEADDEGEPEEGTSKDEEGRASQEGPPGPE

SEQ ID NO: 243 - protein, 1251 aa, Homo sapiens
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSRRVLTWLMKGVEKVIPQPVHSITEDPAQILGHGSTGDTGCTDEPNEALEAQDTRPGLRLLLWLEQNLERVLPQPPKSSEVWRDEPAVATGAASDPAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTISILPGGQVEPDLVLEEVEPPWEDAHQDVSTSPQGTEVVPAYEEENKAVEKMPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARRMLRSNNKPKEEKSVLILPPRAGTPKLFNAALAMTGKMGGKGAKGGKLAHLRARLKELAALEAAAKQQELVEQAKSSQDVKGEEGSAAPDQHTHPKEAATDPPAPRTPPEPPGSPPSSPPPASLGRPEGEEEGPAEPEEHSVRICMSPGPEPGEQILSVKMPEEREEKAE

SEQ ID NO: 244 - protein, 809 aa, Homo sapiens
MFKSLTKVNKVKPIGENNENEQSSRRNEEGSHPSNQSQQTTAQEENKGEEKSLKTKSTPVTSEEPHTNIQDKLSKKNSSGDLTTNPDPQNAAEPTGTVPEQKEMDPGKEGPNSPQNKPPAAPVINEYADAQLHNLVKRMRQRTALYKKKLVEGDLSSPEASPQTAKPTAVPPVKESDDKPTEHYYRLLWFKVKKMPLTEYLKRIKLPNSIDSYTDRLYLLWLLLVTLAYNWNCCFIPLRLVFPYQTADNIHYWLIADIICDIIYLYDMLFIQPRLQFVRGGDIIVDSNELRKHYRTSTKFQLDVASIIPFDICYLFFGFNPMFRANRMLKYTSFFEFNHHLESIMDKAYIYRVIRTTGYLLFILHINACVYYWASNYEGIGTTRWVYDGEGNEYLRCYYWAVRTLITIGGLPEPQTLFEIVFQLLNFFSGVFVFSSLIGQMRDVIGAATANQNYFRACMDDTIAYMNNYSIPKLVQKRVRTWYEYTWDSQRMLDESDLLKTLPTTVQLALAIDVNFSIISKVDLFKGCDTQMIYDMLLRLKSVLYLPGDFVCKKGEIGKEMYIIKHGEVQVLGGPDGTKVLVTLKAGSVFGEISLLAAGGGNRRTANVVAHGFANLLTLDKKTLQEILVHYPDSERILMKKARVLLKQKAKTAEATPPRKDLALLFPPKEETPKLFKTLLGGTGKASLARLLKLKREQAAQKKENSEGGEEEGKENEDKQKENEDKQKENEDKGKENEDKDKGREPEEKPLDRPECTASPIAVEEEPHSVRRTVLPRGTSRQSLIISMAPSAEGGEEVLTIEVKEKAKQ

SEQ ID NO: 245 - protein, 890 aa, Homo sapiens
MEGGGKPNSSSNSRDDGNSVFPAKASATGAGPAAAEKRLGTPPGGGGAGAKEHGNSVCFKVDGGGGGGGGGGGGEEPAGGFEDAEGPRRQYGFMQRQFTSMLQPGVNKFSLRMFGSQKAVEKEQERVKTAGFWIIHPYSDFRFYWDLIMLIMMVGNLVIIPVGITFFTEQTTTPWIIFNVASDTVFLLDLIMNFRTGTVNEDSSEIILDPKVIKMNYLKSWFVVDFISSIPVDYIFLIVEKGMDSEVYKTARALRIVRFTKILSLLRLLRLSRLIRYIHQWEEIFHMTYDLASAVVRIFNLIGMMLLLCHWDGCLQFLVPLLQDFPPDCWVSLNEMVNDSWGKQYSYALFKAMSHMLCIGYGAQAPVSMSDLWITMLSMIVGATCYAMFVGHATALIQSLDSSRRQYQEKYKQVEQYMSFHKLPADMRQKIHDYYEHRYQGKIFDEENILNELNDPLREEIVNFNCRKLVATMPLFANADPNFVTAMLSKLRFEVFQPGDYIIREGAVGKKMYFIQHGVAGVITKSSKEMKLTDGSYFGEICLLTKGRRTASVRADTYCRLYSLSVDNFNEVLEEYPMMRRAFETVAIDRLDRIGKKNSILLQKFQKDLNTGVFNNQENEILKQIVKHDREMVQAIAPINYPQMTTLNSTSSTTTPTSRMRTQSPPVYTATSLSHSNLHSPSPSTQTPQPSAILSPCSYTTAVCSPPVQSPLAARTFHYASPTASQLSLMQQQPQQQVQQSQPPQTQPQQPSPQPQTPGSSTPKNEVHKSTQALHNTNLTREVRPLSASQPSLPHEVSTLISRPHPTVGESLASIPQPVTAVPGTGLQAGGRSTVPQRVTLFRQMSSGAIPPNRGVPPAPPPPAAALPRESSSVLNTDPDAEKPRFASNL

SEQ ID NO: 246 - protein, 889 aa, Homo sapiens
MDARGGGGRPGESPGATPAPGPPPPPPPAPPQQQPPPPPPPAPPPGPGPAPPQHPPRAEALPPEAADEGGPRGRLRSRDSSCGRPGTPGAASTAKGSPNGECGRGEPQCSPAGPEGPARGPKVSFSCRGAASGPAPGPGPAEEAGSEEAGPAGEPRGSQASFMQRQFGALLQPGVNKFSLRMFGSQKAVEREQERVKSAGAWIIHPYSDFRFYWDFTMLLFMVGNLIIIPVGITFFKDETTAPWIVFNVVSDTFFLMDLVLNFRTGIVIEDNTEIILDPEKIKKKYLRTWFVVDFVSSIPVDYIFLIVEKGIDSEVYKTARALRIVRFTKILSLLRLLRLSRLIRYIHQWEEIFHMTYDLASAVMRICNLISMMLLLCHWDGCLQFLVPMLQDFPRNCWVSINGMVNHSWSELYSFALFKAMSHMLCIGYGRQAPESMTDIWLTMLSMIVGATCYAMFIGHATALIQSLDSSRRQYQEKYKQVEQYMSFHKLPADFRQKIHDYYEHRYQGKMFDEDSILGELNGPLREEIVNFNCRKLVASMPLFANADPNFVTAMLTKLKFEVFQPGDYIIREGTIGKKMYFIQHGVVSVLTKGNKEMKLSDGSYFGEICLLTRGRRTASVRADTYCRLYSLSVDNFNEVLEEYPMMRRAFETVAIDRLDRIGKKNSILLHKVQHDLNSGVFNNQENAIIQEIVKYDREMVQQAELGQRVGLFPPPPPPPQVTSAIATLQQAAAMSFCPQVARPLVGPLALGSPRLVRRPPPGPAPAAASPGPPPPASPPGAPASPRAPRTSPYGGLPAAPLAGPALPARRLSRASRPLSASQPSLPHGAPGPAASTRPASSSTPRLGPTPAARAAAPSPDRRDSASPGAAGGLDPQDSARSRLSSNL

SEQ ID NO: 247 - protein, 774 aa, Homo sapiens
MEAEQRPAAGASEGATPGLEAVPPVAPPPATAASGPIPKSGPEPKRRHLGTLLQPTVNKFSLRVFGSHKAVEIEQERVKSAGAWIIHPYSDFRFYWDLIMLLLMVGNLIVLPVGITFFKEENSPPWIVFNVLSDTFFLLDLVLNFRTGIVVEEGAEILLAPRAIRTRYLRTWFLVDLISSIPVDYIFLVVELEPRLDAEVYKTARALRIVRFTKILSLLRLLRLSRLIRYIHQWEEIFHMTYDLASAVVRIFNLIGMMLLLCHWDGCLQFLVPMLQDFPPDCWVSINHMVNHSWGRQYSHALFKAMSHMLCIGYGQQAPVGMPDVWLTMLSMIVGATCYAMFIGHATALIQSLDSSRRQYQEKYKQVEQYMSFHKLPADTRQRIHEYYEHRYQGKMFDEESILGELSEPLREEIINFTCRGLVAHMPLFAHADPSFVTAVLTKLRFEVFQPGDLVVREGSVGRKMYFIQHGLLSVLARGARDTRLTDGSYFGEICLLTRGRRTASVRADTYCRLYSLSVDHFNAVLEEFPMMRRAFETVAMDRLLRIGKKNSILQRKRSEPSPGSSGGIMEQHLVQHDRDMARGVRGRAPSTGAQLSGKPVLWEPLVHAPLQAAAVTSNVAIALTHQRGPLPLSPDSPATLLARSAWRSAGSPASPLVPVRAGPWASTSRLPAPPARTLHASLSRAGRSQVSLLGPPPGGGGRRLGPRGRPLSASQPSLPQRATGDGSPGRKGSGSERLPPSGLLAKPPRTAQPPRPPVPEPATPRGLQLSANM

SEQ ID NO: 248 - protein, 1203 aa, Homo sapiens
MDKLPPSMRKRLYSLPQQVGAKAWIMDEEEDAEEEGAGGRQDPSRRSIRLRPLPSPSPSAAAGGTESRSSALGAADSEGPARGAGKSSTNGDCRRFRGSLASLGSRGGGSGGTGSGSSHGHLHDSAEERRLIAEGDASPGEDRTPPGLAAEPERPGASAQPAASPPPPQQPPQPASASCEQPSVDTAIKVEGGAAAGDQILPEAEVRLGQAGFMQRQFGAMLQPGVNKFSLRMFGSQKAVEREQERVKSAGFWIIHPYSDFRFYWDLTMLLLMVGNLIIIPVGITFFKDENTTPWIVFNVVSDTFFLIDLVLNFRTGIVVEDNTEIILDPQRIKMKYLKSWFMVDFISSIPVDYIFLIVETRIDSEVYKTARALRIVRFTKILSLLRLLRLSRLIRYIHQWEEIFHMTYDLASAVVRIVNLIGMMLLLCHWDGCLQFLVPMLQDFPDDCWVSINNMVNNSWGKQYSYALFKAMSHMLCIGYGRQAPVGMSDVWLTMLSMIVGATCYAMFIGHATALIQSLDSSRRQYQEKYKQVEQYMSFHKLPPDTRQRIHDYYEHRYQGKMFDEESILGELSEPLREEIINFNCRKLVASMPLFANADPNFVTSMLTKLRFEVFQPGDYIIREGTIGKKMYFIQHGVVSVLTKGNKETKLADGSYFGEICLLTRGRRTASVRADTYCRLYSLSVDNFNEVLEEYPMMRRAFETVALDRLDRIGKKNSILLHKVQHDLNSGVFNYQENEIIQQIVQHDREMAHCAHRVQAAASATPTPTPVIWTPLIQAPLQAAAATTSVAIALTHHPRLPAAIFRPPPGSGLGNLGAGQTPRHLKRLQSLIPSALGSASPASSPSQVDTPSSSSFHIQQLAGFSAPAGLSPLLPSSSSSPPPGACGSPSAPTPSAGVAATTIAGFGHFHKALGGSLSSSDSPLLTPLQPGARSPQAAQPSPAPPGARGGLGLPEHFLPPPPSSRSPSSSPGQLGQPPGELSLGLATGPLSTPETPPRQPEPPSLVAGASGGASPVGFTPRGGLSPPGHSPGPPRTFPSAPPRASGSHGSLLLPPASSPPPPQVPQRRGTPPLTPGRLTQDLKLISASQPALPQDGAQTLRRASPHSSGESMAAFPLFPRAGGGSGGSGSSGGLGPPGRPYGAIPGQHVTLPRKTSSGSLPPPLSLFGARATSSGGPPLTAGPQREPGARPEPVRSKLPSNL

SEQ ID NO: 249 - protein, 759 aa, Homo sapiens
MMAALYPSTDLSGASSSSLPSSPSSSSPNEVMALKDVREVKEENTLNEKLFLLACDKGDYYMVKKILEENSSGDLNINCVDVLGRNAVTITIENENLDILQLLLDYGCQKLMERIQNPEYSTTMDVAPVILAAHRNNYEILTMLLKQDVSLPKPHAVGCECTLCSAKNKKDSLRHSRFRLDIYRCLASPALIMLTEEDPILRAFELSADLKELSLVEVEFRNDYEELARQCKMFAKDLLAQARNSRELEVILNHTSSDEPLDKRGLLEERMNLSRLKLAIKYNQKEFVSQSNCQQFLNTVWFGQMSGYRRKPTCKKIMTVLTVGIFWPVLSLCYLIAPKSQFGRIIHTPFMKFIIHGASYFTFLLLLNLYSLVYNEDKKNTMGPALERIDYLLILWIIGMIWSDIKRLWYEGLEDFLEESRNQLSFVMNSLYLATFALKVVAHNKFHDFADRKDWDAFHPTLVAEGLFAFANVLSYLRLFFMYTTSSILGPLQISMGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVIVGTYNVVVVIVLTKLLVAMLHKSFQLIANHEDKEWKFARAKLWLSYFDDKCTLPPPFNIIPSPKTICYMISSLSKWICSHTSKGKVKRQNSLKEWRNLKQKRDENYQKVMCCLVHRYLTSMRQKMQSTDQATVENLNELRQDLSKFRNEIRDLLGFRTSKYAMFYPRN

SEQ ID NO: 250 - protein, 848 aa, Homo sapiens
MEGSPSLRRMTVMREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKFVAHPNCQQQLLTIWYENLSGLREQTIAIKCLVVLVVALGLPFLAIGYWIAPCSRLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 251 - protein, 977 aa, Homo sapiens
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGLTEENFKELKQDISSFRFEVLGLLRGSKLSTIQSANASKESSNSADSDEKSDSEGNSKDKKKNFSLFDLTTLIHPRSAAIASERHNISNGSALVVQEPPREKQRKVNFVTDIKNFGLFHRRSKQNAAEQNANQIFSVSEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 252 - protein, 973 aa, Homo sapiens
MAQLYYKKVNYSPYRDRIPLQIVRAETELSAEEKAFLNAVEKGDYATVKQALQEAEIYYNVNINCMDPLGRSALLIAIENENLEIMELLLNHSVYVGDALLYAIRKEVVGAVELLLSYRRPSGEKQVPTLMMDTQFSEFTPDITPIMLAAHTNNYEIIKLLVQKRVTIPRPHQIRCNCVECVSSSEVDSLRHSRSRLNIYKALASPSLIALSSEDPILTAFRLGWELKELSKVENEFKAEYEELSQQCKLFAKDLLDQARSSRELEIILNHRDDHSEELDPQKYHDLAKLKVAIKYHQKEFVAQPNCQQLLATLWYDGFPGWRRKHWVVKLLTCMTIGFLFPMLSIAYLISPRSNLGLFIKKPFIKFICHTASYLTFLFMLLLASQHIVRTDLHVQGPPPTVVEWMILPWVLGFIWGEIKEMWDGGFTEYIHDWWNLMDFAMNSLYLATISLKIVAYVKYNGSRPREEWEMWHPTLIAEALFAISNILSSLRLISLFTANSHLGPLQISLGRMLLDILKFLFIYCLVLLAFANGLNQLYFYYETRAIDEPNNCKGIRCEKQNNAFSTLFETLQSLFWSVFGLLNLYVTNVKARHEFTEFVGATMFGTYNVISLVVLLNMLIAMMNNSYQLIADHADIEWKFARTKLWMSYFDEGGTLPPPFNIIPSPKSFLYLGNWFNNTFCPKRDPDGRRRRRNLRSFTERNADSLIQNQHYQEVIRNLVKRYVAAMIRNSKTHEGLTEENFKELKQDISSFRYEVLDLLGNRKHPRSFSTSSTELSQRDDNNDGSGGARAKSKSVSFNLGCKKKTCHGPPLIRTMPRSSGAQGKSKAESSSKRSFMGPSLKKLGLLFSKFNGHMSEPSSEPMYTISDGIVQQHCMWQDIRYSQMEKGKAEACSQSEINLSEVELGEVQGAAQSSECPLACSSSLHCASSICSSNSKLLDSSEDVFETWGEACDLLMHKWGDGQEEQVTTRL

SEQ ID NO: 253 - protein, 931 aa, Homo sapiens
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKFVAHPNCQQQLLSIWYENLSGLRQQTMAVKFLVVLAVAIGLPFLALIYWFAPCSKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 254 - protein, 862 aa, Homo sapiens
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKNDYRKLSMQCKDFVVGVLDLCRDTEEVEAILNGDVNFQVWSDHHRPSLSRIKLAIKYEVKKFVAHPNCQQQLLTMWYENLSGLRQQSIAVKFLAVFGVSIGLPFLAIAYWIAPCSKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 255 - protein, 839 aa, Homo sapiens [sequence omitted]

SEQ ID NO: 256 - protein, 764 aa, Homo sapiens
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFLFQALLTVVSQVLCFLAIEWYLPLLVSALVLGWLNLLYYTRGFQHTGIYSVMIQKVILRDLLRFLLIYLVFLFGFAVALVSLSQEAWRPEAPTGPNATESVQPMEGQEDEGNGAQYRGILEASLELFKFTIGMGELAFQEQLHFRGMVLLLLLAYVLLTYILLLNMLIALMSETVNSVATDSWSIWKLQKAISVLEMENGYWWCRKKQRAGVMLTVGTKPDGSPDERWCFRVEEVNWASWEQTLPTLCEDPSGAGVPRTLENPVLASPPKEDEDGASEENYVPVQLLQSN

SEQ ID NO: 257 - protein, 790 aa, Homo sapiens
MKAHPKEMVPLMGKRVAAPSGNPAILPEKRPAEITPTKKSAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTDFNKIQDSSRNNSKTTLNAFEEVEEFPETSV

SEQ ID NO: 258 - protein, 871 aa, Homo sapiens
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 259 - protein, 1603 aa, Homo sapiens
MKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 260 - protein, 1503 aa, Homo sapiens
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 261 - protein, 1569 aa, Homo sapiens
MYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRCLPFFSLDSRLFYSFWGSCQLDSVGIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 262 - protein, 1214 aa, Homo sapiens
MVVPEKEQSWIPKIFKKKTCTTFIVDSTDPGGTLCQCGRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 263 - protein, 1165 aa, Homo sapiens
MQDVQGPRPGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMMKDVFFFLFFLSVWLVAYGVTTQALLHPHDGRLEWIFRRVLYRPYLQIFGQIPLDEIDEARVNCSTHPLLLEDSPSCPSLYANWLVILLLVTFLLVTNVLLMNLLIAMFSYTFQVVQGNADMFWKFQRYNLIVEYHERPALAPPFILLSHLSLTLRRVFKKEAEHKREHLERDLPDPLDQKVVTWETVQKENFLSKMEKRRRDSEGEVLRKTAHRVDFIAKYLGGLREQEKRIKCLESQINYCSVLVSSVADVLAQGGGPRSSQHCGEGSQLVAADHRGGLDGWEQPGAGQPPSDT

SEQ ID NO: 264 - protein, 2022 aa, Homo sapiens
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 265 - protein, 1865 aa, Homo sapiens
MSQKSWIESTLTKRECVYIIPSSKDPHRCLPGCQICQQLVRCFCGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPSQPSCKSHLETGTKDQETVCSKATEGDNTEFGAFVGHRDSMDLQRFKETSNKIKILSNNNTSENTLKRVSSLAGFTDCHRTSIPVHSKQAEKISRRPSTEDTHEVDSKAALIPDWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 266 - protein, 1104 aa, Homo sapiens
MSFRAARLSMRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 267 - protein, 1119 aa, Homo sapiens
MKRSLRKMWRPGEKKEPQGVVYEDVPDDTEDFKESLKVVFEGSAYGLQNFNKQKKLKRCDDMDTFFLHYAAAEGQIELMEKITRDSSLEVLHEMDDYGNTPLHCAVEKNQIESVKFLLSRGANPNLRNFNMMAPLHIAVQGMNNEVMKVLLEHRTIDVNLEGENGNTAVIIACTTNNSEALQILLKKGAKPCKSNKWGCFPIHQAAFSGSKECMEIILRFGEEHGYSRQLHINFMNNGKATPLHLAVQNGDLEMIKMCLDNGAQIDPVEKGRCTAIHFAATQGATEIVKLMISSYSGSVDIVNTTDGCHETMLHRASLFDHHELADYLISVGADINKIDSEGRSPLILATASASWNIVNLLLSKGAQVDIKDNFGRNFLHLTVQQPYGLKNLRPEFMQMQQIKELVMDEDNDGCTPLHYACRQGGPGSVNNLLGFNVSIHSKSKDKKSPLHFAASYGRINTCQRLLQDISDTRLLNEGDLHGMTPLHLAAKNGHDKVVQLLLKKGALFLSDHNGWTALHHASMGGYTQTMKVILDTNLKCTDRLDEDGNTALHFAAREGHAKAVALLLSHNADIVLNKQQASFLHLALHNKRKEVVLTIIRSKRWDECLKIFSHNSPGNKCPITEMIEYLPECMKVLLDFCMLHSTEDKSCRDYYIEYNFKYLQCPLEFTKKTPTQDVIYEPLTALNAMVQNNRIELLNHPVCKEYLLMKWLAYGFRAHMMNLGSYCLGLIPMTILVVNIKPGMAFNSTGIINETSDHSEILDTTNSYLIKTCMILVFLSSIFGYCKEAGQIFQQKRNYFMDISNVLEWIIYTTGIIFVLPLFVEIPAHLQWQCGAIAVYFYWMNFLLYLQRFENCGIFIVMLEVILKTLLRSTVVFIFLLLAFGLSFYILLNLQDPFSSPLLSIIQTFSMMLGDINYRESFLEPYLRNELAHPVLSFAQLVSFTIFVPIVLMNLLIGLAVGDIAEVQKHASLKRIAMQVELHTSLEKKLPLWFLRKVDQKSTIVYPNKPRSGGMLFHIFCFLFCTGEIRQEIPNADKSLEMEILKQKYRLKDLTFLLEKQHELIKLIIQKMEIISETEDDDSHCSFQDRFKKEQMEQRNSRWNTVLRAVKAKTHHLEP

SEQ ID NO: 268 - protein, 968 aa, Homo sapiens
MVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRLLVEFPATGGVIPSWQFQPLKLIRYVTTFDFFLAACEIIFCFFIFYYVVEEILEIRIHKLHYFRSFWNCLDVVIVVLSVVAIGINIYRTSNVEVLLQFLEDQNTFPNFEHLAYWQIQFNNIAAVTVFFVWIKLFKFINFNRTMSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 269 - protein, 805 aa, Homo sapiens
MNAVGSPEGQELQKLGSGAWDNPAYSGPPSPHGTLRVCTISSTGPLQPQPKKPEDEPQETAYRTQVSSCCLHICQGIRGLWGTTLTENTAENRELYIKTTLRELLVYIVFLVDICLLTYGMTSSSAYYYTKVMSELFLHTPSDTGVSFQAISSMADFWDFAQGPLLDSLYWTKWYNNQSLGHGSHSFIYYENMLLGVPRLRQLKVRNDSCVVHEDFREDILSCYDVYSPDKEEQLPFGPFNGTAWTYHSQDELGGFSHWGRLTSYSGGGYYLDLPGSRQGSAEALRALQEGLWLDRGTRVVFIDFSVYNANINLFCVLRLVVEFPATGGAIPSWQIRTVKLIRYVSNWDFFIVGCEVIFCVFIFYYVVEEILELHIHRLRYLSSIWNILDLVVILLSIVAVGFHIFRTLEVNRLMGKLLQQPNTYADFEFLAFWQTQYNNMNAVNLFFAWIKIFKYISFNKTMTQLSSTLARCAKDILGFAVMFFIVFFAYAQLGYLLFGTQVENFSTFIKCIFTQFRIILGDFDYNAIDNANRILGPAYFVTYVFFVFFVLLNMFLAIINDTYSEVKEELAGQKDELQLSDLLKQGYNKTLLRLRLRKERVSDVQKVLQGGEQEIQFEDFTNTLRELGHAEHEITELTATFTKFDRDGNRILDEKEQEKMRQDLEEERVALNTEIEKLGRSIVSSPQGKSGPEAARAGGWVSGEEFYMLTRRVLQLETVLEGVVSQIDAVGSKLKMLERKGWLAPSPGVKEQAIWKHPQPAPAVTPDPWGVQGGQESEVPYKREEEALEERRLSRGEIPTLQRS

SEQ ID NO: 270 - protein, 613 aa, Homo sapiens
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRLDFELGKMIKQSYKNVLEKFRLKKAQKDEDKKTKGSGDLAEQARREGFDENEIQNAEQMKKWKERLEKKYYSMEIQDDYQPVTQEEFRDGTTTKYKMRFSECLTKRI

SEQ ID NO: 271 - protein, 580 aa, Homo sapiens
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTDCIQVDPPERPPPPPSDDLTLLESSSSYKNLTLKFHKLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 272 - protein, 566 aa, Homo sapiens
MARQPYRFPQARIPERGSGVFRLTVRNAMAHRDSEMKEECLREDLKFYFMSPCEKYRARRQIPWKLGLQILKIVMVTTQLVRFGLSNQLVVAFKEDNTVAFKHLFLKGYSGTDEDDYSCSVYTQEDAYESIFFAINQYHQLKDITLGTLGYGENEDNRIGLKVCKQHYKKGTMFPSNETLNIDNDVELDCVQLDLQDLSKKPPDWKNSSFFRLEFYRLLQVEISFHLKGIDLQTIHSRELPDCYVFQNTIIFDNKAHSGKIKIYFDSDAKIEECKDLNIFGSTQKNAQYVLVFDAFVIVICLASLILCTRSIVLALRLRKRFLNFFLEKYKRPVCDTDQWEFINGWYVLVIISDLMTIIGSILKMEIKAKNLTNYDLCSIFLGTSTLLVWVGVIRYLGYFQAYNVLILTMQASLPKVLRFCACAGMIYLGYTFCGWIVLGPYHDKFENLNTVAECLFSLVNGDDMFATFAQIQQKSILVWLFSRLYLYSFISLFIYMILSLFIALITDSYDTIKKFQQNGFPETDLQEFLKECSSKEEYQKESSAFLSCICCRRRKRSDDHLIPIS

SEQ ID NO: 273 - protein, 553 aa, Homo sapiens
MADPEVVVSSCSSHEEENRCNFNQQTSPSEELLLEDQMRRKLKFFFMNPCEKFWARGRKPWKLAIQILKIAMVTIQLVLFGLSNQMVVAFKEENTIAFKHLFLKGYMDRMDDTYAVYTQSDVYDQLIFAVNQYLQLYNVSVGNHAYENKGTKQSAMAICQHFYKRGNIYPGNDTFDIDPEIETECFFVEPDEPFHIGTPAENKLNLTLDFHRLLTVELQFKLKAINLQTVRHQELPDCYDFTLTITFDNKAHSGRIKISLDNDISIRECKDWHVSGSIQKNTHYMMIFDAFVILTCLVSLILCIRSVIRGLQLQQEFVNFFLLHYKKEVSVSDQMEFVNGWYIMIIISDILTIIGSILKMEIQAKSLTSYDVCSILLGTSTMLVWLGVIRYLGFFAKYNLLILTLQAALPNVIRFCCCAAMIYLGYCFCGWIVLGPYHDKFRSLNMVSECLFSLINGDDMFATFAKMQQKSYLVWLFSRIYLYSFISLFIYMILSLFIALITDTYETIKQYQQDGFPETELRTFISECKDLPNSGKYRLEDDPPVSLFCCCKK

SEQ ID NO: 274 - protein, 988 aa, Homo sapiens
MEQSRSQQRGGEQSWWGSDPQYQYMPFEHCTSYGLPSENGGLQHRLRKDAGPRHNVHPTQIYGHHKEQFSDREQDIGMPKKTGSSSTVDSKDEDHYSKCQDCIHRLGQVVRRKLGEDGIFLVLLGLLMALVSWSMDYVSAKSLQAYKWSYAQMQPSLPLQFLVWVTFPLVLILFSALFCHLISPQAVGSGIPEMKTILRGVVLKEYLTMKAFVAKVVALTAGLGSGIPVGKEGPFVHIASICAAVLSKFMSVFCGVYEQPYYYSDILTVGCAVGVGCCFGTPLGGVLFSIEVTSTYFAVRNYWRGFFAATFSAFVFRVLAVWNKDAVTITALFRTNFRMDFPFDLKELPAFAAIGICCGLLGAVFVYLHRQVMLGVRKHKALSQFLAKHRLLYPGIVTFVIASFTFPPGMGQFMAGELMPREAISTLFDNNTWVKHAGDPESLGQSAVWIHPRVNVVIIIFLFFVMKFWMSIVATTMPIPCGGFMPVFVLGAAFGRLVGEIMAMLFPDGILFDDIIYKILPGGYAVIGAAALTGAVSHTVSTAVICFELTGQIAHILPMMVAVILANMVAQSLQPSLYDSIIQVKKLPYLPDLGWNQLSKYTIFVEDIMVRDVKFVSASYTYGELRTLLQTTTVKTLPLVDSKDSMILLGSVERSELQALLQRHLCPERRLRAAQEMARKLSELPYDGKARLAGEGLPGAPPGRPESFAFVDEDEDEDLSGKSELPPSLALHPSTTAPLSPEEPNGPLPGHKQQPEAPEPAGQRPSIFQSLLHCLLGRARPTKKKTTQDSTDLVDNMSPEEIEAWEQEQLSQPVCFDSCCIDQSPFQLVEQTTLHKTHTLFSLLGLHLAYVTSMGKLRGVLALEELQKAIEGHTKSGVQLRPPLASFRNTTSTRKSTGAPPSSAENWNLPEDRPGATGTGDVIAASPETPVPSPSPEPPLSLAPGKVEGELEELELVESPGLEEELADILQGPSLRSTDEEDEDELIL

SEQ ID NO: 275 - protein, 898 aa, Homo sapiens
MAAAAAEEGMEPRALQYEQTLMYGRYTQDLGAFAKEEAARIRLGGPEPWKGPPSSRAAPELLEYGRSRCARCRVCSVRCHKFLVSRVGEDWIFLVLLGLLMALVSWVMDYAIAACLQAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKFWMSALATTIPVPCGAFMPVFVIGAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPTPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKTHTIFSLLGVDHAYVTSIGRLIGIVTLKELRKAIEGSVTAQGVKVRPPLASFRDSATSSSDTETTEVHALWGPHSRHGLPREGSPSDSDDKCQ

SEQ ID NO: 276 - protein, 866 aa, Homo sapiens
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGIVLGIITKKNILEHLEQLKQHVEPLAPPWHYNKKRYPPAYGPDGKPRPRFNNVQLNLTDEEREETEEEVYLLNSTTL

SEQ ID NO: 277 - protein, 760 aa, Homo sapiens
MVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEGASAYILNYLMYILWALLFAFLAVSLVRVFAPYACGSGIPEIKTILSGFIIRGYLGKWTLLIKTVTLVLVVSSGLSLGKEGPLVHVACCCGNFFSSLFSKYSKNEGKRREVLSAAAAAGVSVAFGAPIGGVLFSLEEVSYYFPLKTLWRSFFAALVAAFTLRSINPFGNSRLVLFYVEYHTPWYMAELFPFILLGVFGGLWGTLFIRCNIAWCRRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 278 - protein, 746 aa, Homo sapiens
MDFLEEPIPGVGTYDDFNTIDWVREKSRDRDRHREITNKSKESTWALIHSVSDAFSGWLLMLLIGLLSGSLAGLIDISAHWMTDLKEGICTGGFWFNHEHCCWNSEHVTFEERDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 279 - protein, 869 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVEKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEIVGIITRHNLTYEFLQARLRQHYQTI

SEQ ID NO: 280 - protein, 805 aa, Homo sapiens
MANVSKKVSWSGRDRDDEEAAPLLRRTARPGGGTPLLNGAGPGAARQSPRSALFRVGHMSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAVLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 281 - protein, 563 aa, Homo sapiens
MSRIGGAGLPAAALTGPGRFRMAREEPAPAALAAAGQPGGGRGGERALQGPGVARRGRPSLSRAKLHGLRHMCAGRTAAGGSFQRRALWVLAFCTSFGLLLSWSSNRLLYWLSFPSHTRVHREWSRQLPFPAVTVCNNNPLRFPRLSKGDLYYAGHWLGLLLPNRTARPLVSELLRGDEPRRQWFRKLADFRLFLPPRHFEGISAAFMDRLGHQLEDMLLSCKYRGELCGPHNFSSVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 282 - protein, 574 aa, Homo sapiens
MELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGELLMTPVPFSCHGHGVAPYHPKAGCSLLSHEGPPPQRPFPKPCCLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 283 - protein, 543 aa, Homo sapiens
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLTSHPSLCRHQDSLRLPPHLLPCHTALDLLSVSSEPRPDILDMPSLHVAFPSSPQIKS

SEQ ID NO: 284 - protein, 666 aa, Homo sapiens
MLSGAAGAARRGGAALAPSLTRSLAGTHAGADSCAGADKGSHKETIEERDKRQQRQQRQRQHQGCGAAGSGSDSPTSGPHPVPVLFPLALSLEEQPLPPLPLGRAPGLLAREGQGREALASPSSRGQMPIEIVCKIKFAEEDAKPKEKEAGDEQSLLGAVAPGAAPRDLATFASTSTLHGLGRACGPGPHGLRRTLWALALLTSLAAFLYQAAGLARGYLTRPHLVAMDPAAPAPVAGFPAVTLCNINRFRHSALSDADIFHLANLTGLPPKDRDGHRAAGLRYPEPDMVDILNRTGHQLADMLKSCNFSGHHCSASNFSVVYTRYGKCYTFNADPRSSLPSRAGGMGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPGNETICPPNIYIECADHTLDSLGGGPEGPCFCPTPCNLTRYGKEISMVRIPNRGSARYLARKYNRNETYIRENFLVLDVFFEALTSEAMEQRAAYGLSALLGDLGGQMGLFIGASILTLLEILDYIYEVSWDRLKRVWRRPKTPLRTSTGGISTLGLQELKEQSPCPSRGRVEGGGVSSLLPNHHHPHGPPGGLFEDFAC

SEQ ID NO: 285 - protein, 218 aa, Homo sapiens
MGRLLALVVGAALVSSACGGCVEVDSETEAVYGMTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKANRDMASIVSEIMMYVLIVVLTIWLVAEMIYCYKKIAAATETAAQENASEYLAITSESKENCTGVQVAE

SEQ ID NO: 286 - protein, 215 aa, Homo sapiens
MHRDAWLPRPAFSLTGLSLFFSLVPPGRSMEVTVPATLNVLNGSDARLPCTFNSCYTVNHKQFSLNWTYQECNNCSEEMFLQFRMKIINLKLERFQDRVEFSGNPSKYDVSVMLRNVQPEDEGIYNCYIMNPPDRHRGHGKIHLQVLMEEPPERDSTVAVIVGASVGGFLAVVILVLMVVKCVRRKKEQKLSTDDLKTEEEGKTDGEGNPDDGAK

SEQ ID NO: 287 - protein, 215 aa, Homo sapiens
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLIPLRVTEEAGEDFTSVVSEIMMYILLVFLTLWLLIEMIYCYRKVSKAEEAAQENASDYLAIPSENKENSAVPVEE

SEQ ID NO: 288 - protein, 228 aa, Homo sapiens
MPGAGDGGKAPARWLGTGLLGLFLLPVTLSLEVSVGKATDIYAVNGTEILLPCTFSSCFGFEDLHFRWTYNSSDAFKILIEGTVKNEKSDPKVTLKDDDRITLVGSTKEKMNNISIVLRDLEFSDTGKYTCHVKNPKENNLQHHATIFLQVVDRLEEVDNTVTLIILAVVGGVIGLLILILLIKKLIIFILKKTREKKKECLVSSSGNDNTENGLPGSKAEEKPPSKV

SEQ ID NO: 289 - protein, 598 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASAKQKQKSTEHVPPYDVVPSMRPIILVGPSLKGYEVTDMMQKALFDFLKHRFDGRISITRVTADISLAKRSVLNNPSKHIIIERSNTRSSLAEVQSEIERIFELARTLQLVALDADTINHPAQLSKTSLAPIIVYIKITSPKVLQRLIKSRGKSQSKHLNVQIAASEKLAQCPPEMFDIILDENQLEDACEHLAEYLEAYWKATHPPSSTPPNPLLNRTMATAALAASPAPVSNLQGPYLASGDQPLERATGEHASMHEYPGELGQPPGLYPSSHPPGRAGTLRALSRQDTFDADTPGSRNSAYTELGDSCVDMETDPSEGPGLGDPAGGGTPPARQGSWEDEEEDYEEELTDNRNRGRNKARYCAEGGGPVLGRNKNELEGWGRGVYIR

SEQ ID NO: 290 - protein, 605 aa, Homo sapiens
MQCCGLVHRRRVRVSYGSADSYTSRPSDSDVSLEEDREAVRREAERQAQAQLEKAKTKPVAFAVRTNVSYSAAHEDDVPVPGMAISFEAKDFLHVKEKFNNDWWIGRLVKEGCEIGFIPSPVKLENMRLQHEQRAKQGKFYSSKSGGNSSSSLGDIVPSSRKSTPPSSAIDIDATGLDAEENDIPANHRSPKPSANSVTSPHSKEKRMPFFKKTEHTPPYDVVPSMRPVVLVGPSLKGYEVTDMMQKALFDFLKHRFEGRISITRVTADISLAKRSVLNNPSKHAIIERSNTRSSLAEVQSEIERIFELARTLQLVVLDADTINHPAQLSKTSLAPIIVYVKISSPKVLQRLIKSRGKSQAKHLNVQMVAADKLAQCPPELFDVILDENQLEDACEHLADYLEAYWKATHPPSSSLPNPLLSRTLATSSLPLSPTLASNSQGSQGDQRTDRSAPIRSASQAEEEPSVEPVKKSQHRSSSSAPHHNHRSGTSRGLSRQETFDSETQESRDSAYVEPKEDYSHDHVDHYASHRDHNHRDETHGSSDHRHRESRHRSRDVDREQDHNECNKQRSRHKSKDRYCEKDGEVISKKRNEAGEWNRDVYIRQ

SEQ ID NO: 291 - protein, 484 aa, Homo sapiens
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 292 - protein, 520 aa, Homo sapiens
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 293 - protein, 1091 aa, Homo sapiens
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKNPKSQEPVTLDFLDAELENDIKVEIRNKMIDGESGEKTFRTLVKSQDERYIDKGNRTYTWTPVNGTDYSLALVLPTYSFYYIKAKLEETITQARSKKGKMKDSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 294 - protein, 323 aa, Homo sapiens
MGLFDRGVQMLLTTVGAFAAFSLMTIAVGTDYWLYSRGVCKTKSVSENETSKKNEEVMTHSGLWRTCCLEGNFKGLCKQIDHFPEDADYEADTAEYFLRAVRASSIFPILSVILLFMGGLCIAASEFYKTRHNIILSAGIFFVSAGLSNIIGIIVYISANAGDPSKSDSKKNSYSYGWSFYFGALSFIIAEMVGVLAVHMFIDRHKQLRATARATDYLQASAITRIPSYRYRYQRRSRSSSRSTEPSHSRDASPVGIKGFNTLPSTEISMYTLSRDPLKAATTPTATYNSDRDNSFLQVHNCIQKENKDSLHSNTANRRTTPV

SEQ ID NO: 295 - protein, 1581 aa, Homo sapiens
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLAPSLIPKNWPDQGKIQIQNLSVRYDSSLKPVLKHVNALIAPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 296 - protein, 1549 aa, Homo sapiens
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLFLLSTVVRFAVKAIISVQKLNEFLLSDEIGDDSWRTGESSLPFESCKKHTGVQPKTINRKQPGRYHLDSYEQSTRRLRPAETEDIAIKVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTIAHRVHTILTADLVIVMKRGNILEYDTPESLLAQENGVFASFVRADM

SEQ ID NO: 297 - protein, 557 aa, Homo sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 298 - protein, 1330 aa, Homo sapiens
MQAAPRAGCGAALLLWIVSSCLCRAWTAPSTSQKCDEPLVSGLPHVAFSSSSSISGSYSPGYAKINKRGGAGGWSPSDSDHYQWLQVDFGNRKQISAIATQGRYSSSDWVTQYRMLYSDTGRNWKPYHQDGNIWAFPGNINSDGVVRHELQHPIIARYVRIVPLDWNGEGRIGLRIEVYGCSYWADVINFDGHVVLPYRFRNKKMKTLKDVIALNFKTSESEGVILHGEGQQGDYITLELKKAKLVLSLNLGSNQLGPIYGHTSVMTGSLLDDHHWHSVVIERQGRSINLTLDRSMQHFRTNGEFDYLDLDYEITFGGIPFSGKPSSSSRKNFKGCMESINYNGVNITDLARRKKLEPSNVGNLSFSCVEPYTVPVFFNATSYLEVPGRLNQDLFSVSFQFRTWNPNGLLVFSHFADNLGNVEIDLTESKVGVHINITQTKMSQIDISSGSGLNDGQWHEVRFLAKENFAILTIDGDEASAVRTNSPLQVKTGEKYFFGGFLNQMNNSSHSVLQPSFQGCMQLIQVDDQLVNLYEVAQRKPGSFANVSIDMCAIIDRCVPNHCEHGGKCSQTWDSFKCTCDETGYSGATCHNSIYEPSCEAYKHLGQTSNYYWIDPDGSGPLGPLKVYCNMTEDKVWTIVSHDLQMQTPVVGYNPEKYSVTQLVYSASMDQISAITDSAEYCEQYVSYFCKMSRLLNTPDGSPYTWWVGKANEKHYYWGGSGPGIQKCACGIERNCTDPKYYCNCDADYKQWRKDAGFLSYKDHLPVSQVVVGDTDRQGSEAKLSVGPLRCQGDRNYWNAASFPNPSSYLHFSTFQGETSADISFYFKTLTPWGVFLENMGKEDFIKLELKSATEVSFSFDVGNGPVEIVVRSPTPLNDDQWHRVTAERNVKQASLQVDRLPQQIRKAPTEGHTRLELYSQLFVGGAGGQQGFLGCIRSLRMNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWL

SEQ ID NO: 299 - protein, 419 aa, Homo sapiens
MLAARTGAAGSQISEENTKLRRQSGFSVAGKDKSPKKASENAKDSSLSPSGESQLRARQLALLREVEMNWYLKLCDLSSEHTTVCTTGMPHRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 300 - protein, 367 aa, Homo sapiens
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 301 - protein, 404 aa, Homo sapiens
MQVSIACTEQNLRSRSSEDRLCGPRPGPGGGNGGPAGGGHGNPPGGGGSGPKARAALVPRPPAPAGALRESTGRGTGMKYRNLGKSGLRVSCLGLGTWVTFGSQISDETAEDVLTVAYEHGVNLFDTAEVYAAGKAERTLGNILKSKGWRRSSYVITTKIFWGGQAETERGLSRKHIIEGLRGSLERLQLGYVDIVFANRSDPNCPMEEIVRAMTYVINQGLALYWGTSRWGAAEIMEAYSMARQFNLIPPVCEQAEHHLFQREKVEMQLPELYHKIGVGSVTWYPLACGLITSKYDGRVPDTCRASIKGYQWLKDKVQSEDGKKQQAKVMDLLPVAHQLGCTVAQLAIAWCLRSEGVSSVLLGVSSAEQLIEHLGALQVLSQLTPQTVMEIDGLLGNKPHSKK

SEQ ID NO: 302 - protein, 191 aa, Homo sapiens
MVKKLVMAQKRGETRALCLGVTMVVCAVITYYILVTTVLPLYQKSVWTQESKCHLIETNIRDQEELKGKKVPQYPCLWVNVSAAGRWAVLYHTEDTRDQNQQCSYIPGSVDNYQTARADVEKVRAKFQEQQVFYCFSAPRGNETSVLFQRLYGPQALLFSLFWPTFLLTGGLLIIAMVKSNQYLSILAAQK

SEQ ID NO: 303 - protein, 235 aa, Homo sapiens
MFIWTSGRTSSSYRHDEKRNIYQKIRDHDLLDKRKTVTALKAGEDRAILLGLAMMVCSIMMYFLLGITLLRSYMQSVWTEESQCTLLNASITETFNCSFSCGPDCWKLSQYPCLQVYVNLTSSGEKLLLYHTEETIKINQKCSYIPKCGKNFEESMSLVNVVMENFRKYQHFSCYSDPEGNQKSVILTKLYSSNVLFHSLFWPTCMMAGGVAIVAMVKLTQYLSLLCERIQRINR

SEQ ID NO: 304 - protein, 277 aa, Homo sapiens
MQPFSIPVQITLQGSRRRQGRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 305 - protein, 210 aa, Homo sapiens
MAKLRVAYEYTEAEDKSIRLGLFLIISGVVSLFIFGFCWLSPALQDLQATEANCTVLSVQQIGEVFECTFTCGADCRGTSQYPCVQVYVNNSESNSRALLHSDEHQLLTNPKCSYIPPCKRENQKNLESVMNWQQYWKDEIGSQPFTCYFNQHQRPDDVLLHRTHDEIVLLHCFLWPLVTFVVGVLIVVLTICAKSLAVKAEAMKKRKFS

SEQ ID NO: 306 - protein, 269 aa, Homo sapiens
MASEFKKKLFWRAVVAEFLATTLFVFISIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 307 - protein, 271 aa, Homo sapiens
MWELRSIAFSRAVFAEFLATLLFVFFGLGSALNWPQALPSVLQIAMAFGLGIGTLVQALGHISGAHINPAVTVACLVGCHVSVLRAAFYVAAQLLGAVAGAALLHEITPADIRGDLAVNALSNSTTAGQAVTVELFLTLQLVLCIFASTDERRGENPGTPALSIGFSVALGHLLGIHYTGCSMNPARSLAPAVVTGKFDDHWVFWIGPLVGAILGSLLYNYVLFPPAKSLSERLAVLKGLEPDTDWEEREVRRRQSVELHSPQSLPRGTKA

SEQ ID NO: 308 - protein, 292 aa, Homo sapiens
MGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 309 - protein, 323 aa, Homo sapiens
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 310 - protein, 283 aa, Homo sapiens
MNWTGLYTLLSGVNRHSTAIGRVWLSVIFIFRIMVLVVAAESVWGDEKSSFICNTLQPGCNSVCYDQFFPISHVRLWSLQLILVSTPALLVAMHVAHQQHIEKKMLRLEGHGDPLHLEEVKRHKVHISGTLWWTYVISVVFRLLFEAVFMYVFYLLYPGYAMVRLVKCDVYPCPNTVDCFVSRPTEKTVFTVFMLAASGICIILNVAEVVYLIIRACARRAQRRSNPPSRKGSGFGHRLSPEYKQNEINKLLSEQDGSLKDILRRSPGTGAGLAEKSDRCSAC

SEQ ID NO: 311 - protein, 382 aa, Homo sapiens
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 312 - protein, 14 aa, Artificial Sequence
  V5 antigen
GKPIPNPLLGLDST

The invention claimed is:

1. A method for preparing a protein chip comprising the following steps:
    cloning one or more cDNA(s) of interest encoding one or more membrane proteins expressed in the cells of the nervous system of an animal, and which is (are) involved or suspected of being involved in the occurrence of an encephalopathy associated with neuronal excitability disorders, using an expression vector which allows i) the insertion of a tag, in the same reading frame as the sequence encoding the one or more membrane proteins, and ii) the expression of the one or more membrane proteins fused to said tag,
    expressing the one or more membrane proteins encoded by said cDNA(s), fused to said tag, in cells in culture,
    solubilizing the expressed one or more membrane proteins using a non-denaturing detergent which allows the solubilization of said one or more membrane proteins while at the same time preserving their conformation and their ability to bind to a support, and
    depositing said solubilized one or more membrane proteins on a support, thereby obtaining the chip of interest.

2. The method according to claim 1, wherein said one or more solubilized membrane proteins are selected from the group consisting of an ion channel protein, a transporter protein, and a membrane receptor protein which regulates the activity of an ion protein channel or of a transporter protein.

3. The method according to claim 1, wherein said at least one or more membrane proteins comprise a protein selected from SEQ ID NO: 1 to SEQ ID NO: 311.

4. The method according to claim 1, wherein the one or more membrane proteins comprise a protein selected from the group consisting of a GABA receptor; a glutamate receptor; aquaporin 2 (SEQ ID NO: 307); aquaporin 4 (SEQ ID NO: 309); a potassium channel; a calcium channel; an acetylcholine receptor, a protein associated with voltage gated potassium channels; a glycine receptor; connexin 32 (SEQ ID NO: 310); and connexin 43 (SEQ ID NO: 311).

5. The method of claim 4, wherein the one or more membrane proteins comprise an N-methyl-D-aspartate (NMDA)-activated glutamate receptor.

6. The method of claim 5, wherein the NMDA-activated glutamate receptor is the NMDAR1 receptor (SEQ ID NO: 62).

7. The method according to claim 1, wherein the support upon which the membrane proteins are deposited comprises:
    a) at least 100 different membrane proteins of interest;
    b) between approximately 200 and approximately 400 different proteins of interest;
    c) approximately 250 different proteins of interest; or
    d) approximately 300 different proteins of interest,
    wherein each protein of interest is optionally associated with one or more auxiliary subunits.

8. The method according to claim 1, wherein said detergent is selected from the group consisting of Triton X-100, Triton X-114, Nonidet P-40, CHAPS, sodium cholate, sodium deoxycholate, digitonin, sarkosyl NL30 and octylglucoside.

9. The method according to claim 1, wherein said method does not require an ultracentrifugation step.

10. The method according to claim 1, wherein said method does not comprise a fractionation step using salts.

* * * * *